United States Patent 11,920,167 (ENGINEERED GLYCOSYLTRANSFERASES AND STEVIOL GLYCOSIDE GLUCOSYLATION METHODS) - sequence listing, part 3

SEQ ID NO: 3362 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFHQAWAEQVVLEQGIPAVKILTSGAALFSYFFNFLKGPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQNINAKLIVELGVAVEIVRDEDGRIHRGEIAQVLKDVITGETGEILRGKVRDISKNLRARREEEMNAAAEELIQLCRNRNKYK

SEQ ID NO: 3363 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaagcgtgggcagaacaggtcgtgctagaacaggggatcccggctgttaaaattctaaccagtggtgcggcactgtttagctaccgcttcaacttcctgaagcgcccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3364 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQAWAEQVVLEQGIPAVKILTSGAALFSYRFNFLKRPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3365 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagactccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagaacattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3366 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKTPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQNINAKLIVELGVAVEIVRDEDGRIHRGEIAQVLKDVITGETGEILRGKVRDISKNLRARREEEMNAAAEELIQLCRNRNKYK

SEQ ID NO: 3367 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctactttttcaacttcctgtctactccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagaacattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3368 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYFFNFLSTPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQNINAKLIVELGVAVEIVRDEDGRIHRGEIAQVLKDVITGETGEILRGKVRDISKNLRARREEEMNAAAEELIQLCRNRNKYK

SEQ ID NO: 3369 - DNA, 1350 bp, Artificial Sequence
  "Variant of ADP-beta-1,2-glycosyltransferase"
atgcaccatcatcatgaaggcggtagcggccagaccctgagagtactgatgtttccgtatcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaaccgtgggcagaacaggtcgtgctagaacaggggatcccggctgttaaaattctaaccagtggtgcggcactgtttagctaccgcttcaacttcctgaagggcccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3370 - protein, 450 aa, Artificial Sequence
  "Variant of ADP-beta-1,2-glycosyltransferase"
MHHHHEGGSGQTLRVLMFPYLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQPWAEQVVLEQGIPAVKILTSGAALFSYRFNFLKGPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3371 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagaacattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3372 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQNINAKLIVELGVAVEIVRDEDGRIHRGEIAQVLKDVITGETGEILRGKVRDISKNLRARREEEMNAAAEELIQLCRNRNKYK

SEQ ID NO: 3373 - DNA, 1350 bp, Artificial Sequence
  "Variant of ADP-beta-1,2-glycosyltransferase"
atgcaccatcatcatgaaggcggtagcggccagaccctgagagtactgatgtttccgtatcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctaccgcttcaacttcctgaagactccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3374 - protein, 450 aa, Artificial Sequence
  "Variant of ADP-beta-1,2-glycosyltransferase"
MHHHHEGGSGQTLRVLMFPYLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYRFNFLKTPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3375 - DNA, 1350 bp, Artificial Sequence
  "Variant of ADP-beta-1,2-glycosyltransferase"
atgcaccatcatcatgaaggcggtagcggccagaccctgagagtactgatgtttccgtatcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgtctactccgggtgtagagtttccgtttccggcgatcaacctgtcgaagcgagaacaggtgaagatgcgcgagatgtttgaaaaggagccggatgaagaagatccgttagcacctcacaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3376 - protein, 450 aa, Artificial Sequence
  "Variant of ADP-beta-1,2-glycosyltransferase"
MHHHHEGGSGQTLRVLMFPYLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLSTPGVEFPFPAINLSKREQVKMREMFEKEPDEEDPLAPHNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3377 - DNA, 1350 bp, Artificial Sequence
  "Variant of ADP-beta-1,2-glycosyltransferase"
atgcaccatcatcatgaaggcggtagcggccagaccctgagagtactgatgtttccgtatcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctaccgcttcaacttcctgtctcgcccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3378 - protein, 450 aa, Artificial Sequence
  "Variant of ADP-beta-1,2-glycosyltransferase"
MHHHHEGGSGQTLRVLMFPYLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYRFNFLSRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3379 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcatcaagcgtgggcagaacaggtcgtgctagaacaggggatcccggctgttaaaattctaaccagtggtgcggcactgtttagctactttttcaacttcctgaagcgcccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagaacattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3380 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFHQAWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQNINAKLIVELGVAVEIVRDEDGRIHRGEIAQVLKDVITGETGEILRGKVRDISKNLRARREEEMNAAAEELIQLCRNRNKYK

SEQ ID NO: 3381 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcttcaagcgtgggcagaacaggtcgtgctagaacaggggatcccggctgttaaaattctaaccagtggtgcggcactgtttagctactttttcaacttcctgaagcgcccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagaacattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3382 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQAWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQNINAKLIVELGVAVEIVRDEDGRIHRGEIAQVLKDVITGETGEILRGKVRDISKNLRARREEEMNAAAEELIQLCRNRNKYK

SEQ ID NO: 3383 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcttcaagcgtgggcagaacaggtcgtgctagaacaggggatcccggctgttaaaattctaaccagtggtgcggcactgtttagctactttttcaacttcctgaagggcccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagaacattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3384 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQAWAEQVVLEQGIPAVKILTSGAALFSYFFNFLKGPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQNINAKLIVELGVAVEIVRDEDGRIHRGEIAQVLKDVITGETGEILRGKVRDISKNLRARREEEMNAAAEELIQLCRNRNKYK

SEQ ID NO: 3385 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgacgctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3386 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELTLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3387 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcctggtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3388 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSLVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3389 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgatgctggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3390 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDAGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3391 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgcatgaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3392 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLHELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3393 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaatttggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3394 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEFGRIHRGEIAQVLKDVITGETGEILRGKVRDISKNLRARREEEMNAAAEELIQLCRNRNKYK

SEQ ID NO: 3395 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcctggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3396 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGLEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3397 - DNA, 1350 bp, Artificial Sequence
  "Variant of ADP-beta-1,2-glycosyltransferase"
atgacgcatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3398 - protein, 450 aa, Artificial Sequence
  "Variant of ADP-beta-1,2-glycosyltransferase"
MTHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3399 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcattcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3400 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKIIQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3401 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3402 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELALPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3403 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccacgtggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3404 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPRGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3405 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacatgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3406 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDMMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3407 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccataacaagtacaag

SEQ ID NO: 3408 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNHNKYK

SEQ ID NO: 3409 - DNA, 1350 bp, Artificial Sequence
  "Variant of ADP-beta-1,2-glycosyltransferase"
atgaatcatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3410 - protein, 450 aa, Artificial Sequence
  "Variant of ADP-beta-1,2-glycosyltransferase"
MNHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3411 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacgtgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3412 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDVMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3413 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaatggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3414 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVINGETGEILRGKVRDISKNLRARREEEMNAAAEELIQLCRNRNKYK

SEQ ID NO: 3415 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgccgctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3416 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELPLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3417 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggccgggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3418 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGREQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3419 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacattaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3420 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDINSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3421 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtgcctcatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3422 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVPHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3423 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagtcggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3424 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKESDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3425 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgatttttggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3426 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVIFGETGEILRGKVRDISKNLRARREEEMNAAAEELIQLCRNRNKYK

SEQ ID NO: 3427 - DNA, 1350 bp, Artificial Sequence
  "Variant of ADP-beta-1,2-glycosyltransferase"
atgagtcatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3428 - protein, 450 aa, Artificial Sequence
  "Variant of ADP-beta-1,2-glycosyltransferase"
MSHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3429 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattcagggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3430 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVIQGETGEILRGKVRDISKNLRARREEEMNAAAEELIQLCRNRNKYK

SEQ ID NO: 3431 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgctgaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3432 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGAEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3433 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctcgtcaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3434 - protein, 450 aa, Artificial Sequence
  "Variant of ADP-beta-1,2-glycosyltransferase"
MHHHHEGGSGQTLRVLMFPWLALGHINPFLRIARQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3435 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagctcggtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3436 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSSVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3437 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaaggggttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3438 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEGVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3439 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggatcgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3440 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLDRVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3441 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagactcgaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3442 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDSNSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3443 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctggtgctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3444 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELVLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3445 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacactaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3446 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDTNSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3447 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgggaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3448 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFGKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3449 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagccgtaacctgagagcgagacgcgaggaggaaatgaatgcagcggcggaagaactgatacagctgtgtcgcaaccgcaacaagtacaag

SEQ ID NO: 3450 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISRNLRARREEEMNAAAEELIQLCRNRNKYK

SEQ ID NO: 3451 - DNA, 1350 bp, Artificial Sequence
  "Variant of ADP-beta-1,2-glycosyltransferase"
atgcaccatcatcatgaaggctctagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3452 - protein, 450 aa, Artificial Sequence; identical to SEQ ID NO: 3194
  "Variant of ADP-beta-1,2-glycosyltransferase"

SEQ ID NO: 3453 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttattaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3454 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFIKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3455 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattggtggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3456 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVIGGETGEILRGKVRDISKNLRARREEEMNAAAEELIQLCRNRNKYK

SEQ ID NO: 3457 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccctaacaagtacaag

SEQ ID NO: 3458 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNPNKYK

SEQ ID NO: 3459 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatggcgaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3460 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMANDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3461 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagctctaacctgagagcgagacgcgaggaggaaatgaatgcagcggcggaagaactgatacagctgtgtcgcaaccgcaacaagtacaag

SEQ ID NO: 3462 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISSNLRARREEEMNAAAEELIQLCRNRNKYK

SEQ ID NO: 3463 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgttgaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3464 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGVEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3465 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacttgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3466 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDLMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3467 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcgtggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3468 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFVERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3469 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctggtgaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3470 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILVNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3471 - DNA, 1350 bp, Artificial Sequence
  "Variant of ADP-beta-1,2-glycosyltransferase"
atgcacattcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3472 - protein, 450 aa, Artificial Sequence
  "Variant of ADP-beta-1,2-glycosyltransferase"
MHIHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3473 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccaagctgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3474 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTKLTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3475 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagtatcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3476 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVEYHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3477 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttctcggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3478 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFSERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3479 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttatggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3480 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFMDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3481 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagaccttaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3482 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDLNSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3483 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaaggtggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3484 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEGGRIHRGEIAQVLKDVITGETGEILRGKVRDISKNLRARREEEMNAAAEELIQLCRNRNKYK

SEQ ID NO: 3485 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagctgtaacctgagagcgagacgcgaggaggaaatgaatgcagcggcggaagaactgatacagctgtgtcgcaaccgcaacaagtacaag

SEQ ID NO: 3486 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISCNLRARREEEMNAAAEELIQLCRNRNKYK

SEQ ID NO: 3487 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcacggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3488 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFTERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3489 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaaactctgatacagctgtgtcgcaaccgcaacaagtacaag

SEQ ID NO: 3490 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAETLIQLCRNRNKYK

SEQ ID NO: 3491 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaggatattgacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcccgactggtgagatcctgcgcgcgagagtacgcgacattagcaaacgcctgagagcgagacgcgaggaggaaatgaatgcagcggcggaagaactgatacagctgtgtcgcaaccgcaacgcctacaag

SEQ ID NO: 3492 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGVEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRARVRDISKRLRARREEEMNAAAEELIQLCRNRNAYK

SEQ ID NO: 3493 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaatctgtcgaagcgagaacaggtgaagatgcgcgagatgtttgaaaaggagccggatgaagaagatccgttagcacctggcaatggcggtatcatgctgatgtgcacgagccgcgaaattgaggctaagtacctggactattgcaccgaactgaccaatgtaaaagttgttccggttggtccgccatttcaggatccgatgaccgaggatattgacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 3494 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKRLRARREEEMNAAAEELIQLCRNRNAYK

SEQ ID NO: 3495 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaatctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccgaggatattgacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgggaaagtacgcgacattagcaaaaatctgagagcgagacgcgaggaggaaatgaatgcagcggcggaagaactgatacagctgtgtcgcaaccgcaacgcctacaag

SEQ ID NO: 3496 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3497 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccgaggatattgacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgccgcaaagtacgcgacattagcaaacgcctgagagcgagacgcgaggaggaaatgaatgcagcggcggaagaactgatacagctgtgtcgcaaccgcaacgcctacaag

SEQ ID NO: 3498 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGHEFPFPAINLSKREQVKMREMFEKEPDEEDPLAPGNGGIMLMCTSREIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRRKVRDISKRLRARREEEMNAAAEELIQLCRNRNAYK

SEQ ID NO: 3499 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaatctgtcgaagcgagaacaggtgaagatgcgcgagatgtttgaaaaggagccggatgaagaagatccgttagcacctggcaatgccggtatcatgctgatgtgcacgagccgcgaaattgaggctaagtacctggactattgcaccgaactgaccaatgtaaaagttgttccggttggtccgccatttcaggatccgatgaccgaggatattgacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccagcgaaactggtgagatcctgcgcggcaaagtacgcgacattagcaaaaatctgagagcgagacgcgaggaggaaatgaatgcagcggcggaagaactgatacagctgtgtcgcaaccgcaacgcctacaag

SEQ ID NO: 3500 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNAGIMLMCTSREIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITSETGEILRGKVRDISKNLRARREEEMNAAAEELIQLCRNRNAYK

SEQ ID NO: 3501 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3502 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFEKEPDEEDPLAPGNAGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3503 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaatctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccgaggatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgggaaagtacgcgacattagcaaaaatctgagagcgagacgcgaggaggaaatgaatgcagcggcggaagaactgatacagctgtgtcgcaaccgcaacgcctacaag

SEQ ID NO: 3504 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTEDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3505 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcgatcaatctgtcgaagcgagaacaggtgaagatgcgcgagatgtttgaaaaggagccggatgaagaagatccgttagcacctggcaatgccggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcccgactggtgagatcctgcgcgcgagagtacgcgacattagcaaaaatctgagagcgagacgcgaggaggaaatgaatgcagcggcggaagaactgatacagctgtgtcgcaaccgcaacgcctacaag

SEQ ID NO: 3506 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGHEFPFPAINLSKREQVKMREMFEKEPDEEDPLAPGNAGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRARVRDISKNLRARREEEMNAAAEELIQLCRNRNAYK

SEQ ID NO: 3507 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaattaggtgagatcctgcgccgcaaagtacgcgacattagcaaaaatctgagagcgagacgcgaggaggaaatgaatgcagcggcggaagaactgatacagctgtgtcgcaaccgcaacgcctacaag

SEQ ID NO: 3508 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGELGEILRRKVRDISKNLRARREEEMNAAAEELIQLCRNRNAYK

SEQ ID NO: 3509 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatgccggtatcatgctgatgtgcacgagccgcgaaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcccgttaggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3510 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNAGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPLGEILRGKVRDISKNLRARREEEMNAAAEELIQLCRNRNAYK

SEQ ID NO: 3511 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaatctgtcgaagcgagaacaggtgaagatgcgcgagatgtttgaaaaggagccggatgaagaagatccgttagcacctggcaatggaggtatcatgctgatgtgcacgagccgcgtaattgaggctaagtacctggactattgcaccgaactgaccaatgtaaaagttgttccggttggtccgccatttcaggatccgatgaccgaggatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaatctgagagcgagacgcgaggaggaaatgaatgcagcggcggaagaactgatacagctgtgtcgcaaccgcaacgcctacaag

SEQ ID NO: 3512 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSRVIEAKYLDYCTELTNVKVVPVGPPFQDPMTEDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3513 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccgaggatattgacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcccgactggtgagatcctgcgcggcaaagtacgcgacattagcaaaaatctgagagcgagacgcgaggaggaaatgaatgcagcggcggaagaactgatacagctgtgtcgcaaccgcaacgcctacaag

SEQ ID NO: 3514 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGHEFPFPAINLSKREQVKMREMFEKEPDEEDPLAPGNGGIMLMCTSREIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRGKVRDISKNLRARREEEMNAAAEELIQLCRNRNAYK

SEQ ID NO: 3515 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcgatcaacctgtcgaagcgagaacaggtgaagatgcgcgagatgtttgaaaaggagccggatgaagaagatccgttagcacctggcaatgccggtatcatgctgatgtgcacgagccgcgaaattgaggctaagtacctggactattgcaccgaactgaccaatgtaaaagttgttccggttggtccgccatttcaggatccgatgaccgaggatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcccgttaggtgagatcctgcgcgggagagtacgcgacattagcaaaaacctgagagcgagacgcgaggaggaaatgaatgcagcggcggaagaactgatacagctgtgtcgcaaccgcaacgcctacaag

SEQ ID NO: 3516 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFEKEPDEEDPLAPGNAGIMLMCTSREIEAKYLDYCTELTNVKVVPVGPPFQDPMTEDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPLGEILRGRVRDISKNLRARREEEMNAAAEELIQLCRNRNAYK

SEQ ID NO: 3517 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatgccggtatcatgctgatgtgcacgagccgcgaaattgaggctaagtacctggactattgcaccgaactgaccaatgtaaaagttgttccggttggtccgccatttcaggatccgatgaccaatgatattgacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgagagtacgcgacattagcaaacgcctgagagcgagacgcgaggaggaaatgaatgcagcggcggaagaactgatacagctgtgtcgcaaccgcaacgcctacaag

SEQ ID NO: 3518 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNAGIMLMCTSREIEAKYLDYCTELTNVKVVPVGPPFQDPMTNDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRARVRDISKRLRARREEEMNAAAEELIQLCRNRNAYK

SEQ ID NO: 3519 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgtaattgaggctaagtacctggactattgcaccgaactgaccaatgtaaaagttgttccggttggtccgccatttcaggatccgatgaccgaggatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcccgttaggtgagatcctgcgcgggagagtacgcgacattagcaaaaatctgagagcgagacgcgaggaggaaatgaatgcagcggcggaagaactgatacagctgtgtcgcaaccgcaacgcctacaag

SEQ ID NO: 3520 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFEKEPDEEDPLAPGNGGIMLMCTSRVIEAKYLDYCTELTNVKVVPVGPPFQDPMTEDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPLGEILRGRVRDISKNLRARREEEMNAAAEELIQLCRNRNAYK

SEQ ID NO: 3521 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatccgcctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccgaggatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3522 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAIRLSKREQVKMREMFEKEPDEEDPLAPGNGGIMLMCTSREIEAKYLDYCTELTNVKVVPVGPPFQDPMTEDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3523 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatccgcctgtcgaagcgagaacaggtgaagatgcgcgagatgtttgaaaaggagccggatgaagaagatccgttagcacctggcaatggcggtatcatgctgatgtgcacgagccgcgaaattgaggctaagtacctggactattgcaccgaactgaccaatgtaaaagttgttccggttggtccgccatttcaggatccgatgaccgaggatattgacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgccgcaaagtacgcgacattagcaaaaatctgagagcgagacgcgaggaggaaatgaatgcagcggcggaagaactgatacagctgtgtcgcaaccgcaacgcctacaag

SEQ ID NO: 3524 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAIRLSKREQVKMREMFEKEPDEEDPLAPGNGGIMLMCTSREIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRRKVRDISKNLRARREEEMNAAAEELIQLCRNRNAYK

SEQ ID NO: 3525 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccgaggatattgacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaattaggtgagatcctgcgcgggaaagtacgcgacattagcaaaaatctgagagcgagacgcgaggaggaaatgaatgcagcggcggaagaactgatacagctgtgtcgcaaccgcaacgcctacaag

SEQ ID NO: 3526 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGELGEILRGKVRDISKNLRARREEEMNAAAEELIQLCRNRNAYK

SEQ ID NO: 3527 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgtaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcccgttaggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3528 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFEKEPDEEDPLAPGNGGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPLGEILRGKVRDISKNLRARREEEMNAAAEELIQLCRNRNAYK

SEQ ID NO: 3529 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaatctgtcgaagcgagaacaggtgaagatgcgcgagatgtttgaaaaggagccggatgaagaagatccgttagcacctggcaatggcggtatcatgctgatgtgcacgagccgcgtaattgaggctaagtacctggactattgcaccgaactgaccaatgtaaaagttgttccggttggtccgccatttcaggatccgatgaccgaggatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcccgactggtgagatcctgcgccgcaaagtacgcgacattagcaaaaacctgagagcgagacgcgaggaggaaatgaatgcagcggcggaagaactgatacagctgtgtcgcaaccgcaacgcctacaag

SEQ ID NO: 3530 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSRVIEAKYLDYCTELTNVKVVPVGPPFQDPMTEDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRRKVRDISKNLRARREEEMNAAAEELIQLCRNRNAYK

SEQ ID NO: 3531 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccaatgatattgacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaatctgagagcgagacgcgaggaggaaatgaatgcagcggcggaagaactgatacagctgtgtcgcaaccgcaacgcctacaag

SEQ ID NO: 3532 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGVEFPFPAIRLSKREQVKMREMFEKEPDEEDPLAPGNAGIMLMCTSRVIEAKYLDYCTELTNVKVVPVGPPFQDPMTNDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3533 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggcggtatcatgctgatgtgcacgagccgcgaaattgaggctaagtacctggactattgcaccgaactgaccaatgtaaaagttgttccggttggtccgccatttcaggatccgatgaccgaggatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcccgactggtgagatcctgcgcggcaaagtacgcgacattagcaaaaatctgagagcgagacgcgaggaggaaatgaatgcagcggcggaagaactgatacagctgtgtcgcaaccgcaacgcctacaag

SEQ ID NO: 3534 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTEDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRGKVRDISKNLRARREEEMNAAAEELIQLCRNRNAYK

SEQ ID NO: 3535 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatccgcctgtcgaagcgagaacaggtgaagatgcgcgagatgtttgaaaaggagccggatgaagaagatccgttagcacctggcaatgccggtatcatgctgatgtgcacgagccgcgaaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcccgactggtgagatcctgcgcgggagagtacgcgacattagcaaaaatctgagagcgagacgcgaggaggaaatgaatgcagcggcggaagaactgatacagctgtgtcgcaaccgcaacgcctacaag

SEQ ID NO: 3536 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAIRLSKREQVKMREMFEKEPDEEDPLAPGNAGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRGRVRDISKNLRARREEEMNAAAEELIQLCRNRNAYK

SEQ ID NO: 3537 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatccgcctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcccgttaggtgagatcctgcgcggcaaagtacgcgacattagcaaaaatctgagagcgagacgcgaggaggaaatgaatgcagcggcggaagaactgatacagctgtgtcgcaaccgcaacgcctacaag

SEQ ID NO: 3538 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGVEFPFPAIRLSKREQVKMREMFEKEPDEEDPLAPGNGGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPLGEILRGKVRDISKNLRARREEEMNAAAEELIQLCRNRNAYK

SEQ ID NO: 3539 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcgatccgcctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccgaggatattgacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgccgcaaagtacgcgacattagcaaaaatctgagagcgagacgcgaggaggaaatgaatgcagcggcggaagaactgatacagctgtgtcgcaaccgcaacgcctacaag

SEQ ID NO: 3540 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGHEFPFPAIRLSKREQVKMREMFEKEPDEEDPLAPGNGGIMLMCTSREIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRRKVRDISKNLRARREEEMNAAAEELIQLCRNRNAYK

SEQ ID NO: 3541 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaactagtggtgcggcactgtttagctactttttcaacttcctgaagcgaccgggtcacgagtttccgtttccggcgatccgcctgtcgaagcgagaacaggtgaagatgcgcgagatgtttgaaaaggagccggatgaagaagatccgttagcacctggcaatggcggtatcatgctgatgtgcacgagccgcgaaattgaggctaagtacctggactattgcaccgaactgaccaatgtaaaagttgttccggttggtccgccatttcaggatccgatgaccaatgatattgacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcccgactggtgagatcctgcgcgggaaagtacgcgacattagcaaaaatctgagagcgagacgcgaggaggaaatgaatgcagcggcggaagaactgatacagctgtgtcgcaaccgcaacgcctacaag

SEQ ID NO: 3542 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGHEFPFPAIRLSKREQVKMREMFEKEPDEEDPLAPGNGGIMLMCTSREIEAKYLDYCTELTNVKVVPVGPPFQDPMTNDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRGKVRDISKNLRARREEEMNAAAEELIQLCRNRNAYK

SEQ ID NO: 3543 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatccgcctgtcgaagcgagaacaggtgaagatgcgcgagatgtttgaaaaggagccggatgaagaagatccgttagcacctggcaatgccggtatcatgctgatgtgcacgagccgcgaaattgaggctaagtacctggactattgcaccgaactgaccaatgtaaaagttgttccggttggtccgccatttcaggatccgatgaccgaggatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaatctgagagcgagacgcgaggaggaaatgaatgcagcggcggaagaactgatacagctgtgtcgcaaccgcaacgcctacaag

SEQ ID NO: 3544 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAIRLSKREQVKMREMFEKEPDEEDPLAPGNAGIMLMCTSREIEAKYLDYCTELTNVKVVPVGPPFQDPMTEDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3545 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaggatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcccgactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3546 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAIRLSKREQVKMREMFEKEPDEEDPLAPGNAGIMLMCTSRVIEAKYLDYCTELTNVKVVPVGPPFQDPMTEDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRGKVRDISKNLRARREEEMNAAAEELIQLCRNRNAYK

SEQ ID NO: 3547 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatccgcctgtcgaagcgagaacaggtgaagatgcgcgagatgtttgaaaaggagccggatgaagaagatccgttagcacctggcaatggcggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaattaggtgagatcctgcgcgggaaagtacgcgacattagcaaacgcctgagagcgagacgcgaggaggaaatgaatgcagcggcggaagaactgatacagctgtgtcgcaaccgcaacgcctacaag

SEQ ID NO: 3548 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGVEFPFPAIRLSKREQVKMREMFEKEPDEEDPLAPGNGGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGELGEILRGKVRDISKRLRARREEEMNAAAEELIQLCRNRNAYK

SEQ ID NO: 3549 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggcggtatcatgctgatgtgcacgagccgcgaaattgaggctaagtacctggactattgcaccgaactgaccaatgtaaaagttgttccggttggtccgccatttcaggatccgatgaccgaggatattgacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcccgactggtgagatcctgcgcgggagagtacgcgacattagcaaaaacctgagagcgagacgcgaggaggaaatgaatgcagcggcggaagaactgatacagctgtgtcgcaaccgcaacgcctacaag

SEQ ID NO: 3550 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRGRVRDISKNLRARREEEMNAAAEELIQLCRNRNAYK

SEQ ID NO: 3551 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaatctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccgaggatattgacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3552 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3553 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatccgcctgtcgaagcgagaacaggtgaagatgcgcgagatgtttgaaaaggagccggatgaagaagatccgttagcacctggcaatggcggtatcatgctgatgtgcacgagccgcgtaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3554 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAIRLSKREQVKMREMFEKEPDEEDPLAPGNGGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3555 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcgatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccaatgatattgacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaattaggtgagatcctgcgcggcaaagtacgcgacattagcaaaaatctgagagcgagacgcgaggaggaaatgaatgcagcggcggaagaactgatacagctgtgtcgcaaccgcaacgcctacaag

SEQ ID NO: 3556 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTNDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGELGEILRGKVRDISKNLRARREEEMNAAAEELIQLCRNRNAYK

SEQ ID NO: 3557 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaatctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatattgacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcccgttaggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3558 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPLGEILRGKVRDISKNLRARREEEMNAAAEELIQLCRNRNAYK

SEQ ID NO: 3559 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatccgcctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccgaggatattgacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaattaggtgagatcctgcgccgcaaagtacgcgacattagcaaaaacctgagagcgagacgcgaggaggaaatgaatgcagcggcggaagaactgatacagctgtgtcgcaaccgcaacgcctacaag

SEQ ID NO: 3560 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGVEFPFPAIRLSKREQVKMREMFEKEPDEEDPLAPGNGGIMLMCTSREIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGELGEILRRKVRDISKNLRARREEEMNAAAEELIQLCRNRNAYK

SEQ ID NO: 3561 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaatctgtcgaagcgagaacaggtgaagatgcgcgagatgtttgaaaaggagccggatgaagaagatccgttagcacctggcaatggcggtatcatgctgatgtgcacgagccgcgaaattgaggctaagtacctggactattgcaccgaactgaccaatgtaaaagttgttccggttggtccgccatttcaggatccgatgaccgaggatgctgacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgccgcaaagtacgcgacattagcaaaaatctgagagcgagacgcgaggaggaaatgaatgcagcggcggaagaactgatacagctgtgtcgcaaccgcaacgcctacaag

SEQ ID NO: 3562 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTEDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRRKVRDISKNLRARREEEMNAAAEELIQLCRNRNAYK

SEQ ID NO: 3563 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcgatccgcctgtcgaagcgagaacaggtgaagatgcgcgagatgtttgaaaaggagccggatgaagaagatccgttagcacctggcaatggcggtatcatgctgatgtgcacgagccgcgaaattgaggctaagtacctggactattgcaccgaactgaccaatgtaaaagttgttccggttggtccgccatttcaggatccgatgaccaatgatattgacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaattaggtgagatcctgcgcgggagagtacgcgacattagcaaaaatctgagagcgagacgcgaggaggaaatgaatgcagcggcggaagaactgatacagctgtgtcgcaaccgcaacgcctacaag

SEQ ID NO: 3564 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNGGIMLMCTSREIEAKYLDYCTELTNVKVVPVGPPFQDPMTNDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGELGEILRGRVRDISKNLRARREEEMNAAAEELIQLCRNRNAYK

SEQ ID NO: 3565 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaatctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaggatattgacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaattaggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3566 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGELGEILRGKVRDISKNLRARREEEMNAAAEELIQLCRNRNAYK

SEQ ID NO: 3567 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcgatcaatctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgggaaagtacgcgacattagcaaacgcctgagagcgagacgcgaggaggaaatgaatgcagcggcggaagaactgatacagctgtgtcgcaaccgcaacgcctacaag

SEQ ID NO: 3568 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGHEFPFPAINLSKREQVKMREMFEKEPDEEDPLAPGNGGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKRLRARREEEMNAAAEELIQLCRNRNAYK

SEQ ID NO: 3569 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcgatcaatctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccaatgatattgacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3570 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFEKEPDEEDPLAPGNAGIMLMCTSRVIEAKYLDYCTELTNVKVVPVGPPFQDPMTNDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3571 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcgatcaatctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccgaggatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaatctgagagcgagacgcgaggaggaaatgaatgcagcggcggaagaactgatacagctgtgtcgcaaccgcaacgcctacaag

SEQ ID NO: 3572 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFEKEPDEEDPLAPGNGGIMLMCTSREIEAKYLDYCTELTNVKVVPVGPPFQDPMTEDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3573 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaattaggtgagatcctgcgcgggaaagtacgcgacattagcaaaaatctgagagcgagacgcgaggaggaaatgaatgcagcggcggaagaactgatacagctgtgtcgcaaccgcaacgcctacaag

SEQ ID NO: 3574 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGVEFPFPAINLSKREQVKMREMFEKEPDEEDPLAPGNAGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGELGEILRGKVRDISKNLRARREEEMNAAAEELIQLCRNRNAYK

SEQ ID NO: 3575 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcgatcaatctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaattaggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 3576 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFEKEPDEEDPLAPGNGGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGELGEILRAKVRDISKRLRARREEEMNAAAEELIQLCRNRNAYK

SEQ ID NO: 3577 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcgatccgcctgtcgaagcgagaacaggtgaagatgcgcgagatgtttgaaaaggagccggatgaagaagatccgttagcacctggcaatgccggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaattaggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3578 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGELGEILRGKVRDISKNLRARREEEMNAAAEELIQLCRNRNAYK

SEQ ID NO: 3579 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatccgcctgtcgaagcgagaacaggtgaagatgcgcgagatgtttgaaaaggagccggatgaagaagatccgttagcacctggcaatggcggtatcatgctgatgtgcacgagccgcgaaattgaggctaagtacctggactattgcaccgaactgaccaatgtaaaagttgttccggttggtccgccatttcaggatccgatgaccgaggatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaattaggtgagatcctgcgcggcaaagtacgcgacattagcaaaaatctgagagcgagacgcgaggaggaaatgaatgcagcggcggaagaactgatacagctgtgtcgcaaccgcaacgcctacaag

SEQ ID NO: 3580 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAIRLSKREQVKMREMFEKEPDEEDPLAPGNGGIMLMCTSREIEAKYLDYCTELTNVKVVPVGPPFQDPMTEDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGELGEILRGKVRDISKNLRARREEEMNAAAEELIQLCRNRNAYK

SEQ ID NO: 3581 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatccgcctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatattgacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgggagagtacgcgacattagcaaacgcctgagagcgagacgcgaggaggaaatgaatgcagcggcggaagaactgatacagctgtgtcgcaaccgcaacgcctacaag

SEQ ID NO: 3582 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGVEFPFPAIRLSKREQVKMREMFEKEPDEEDPLAPGNGGIMLMCTSREIEAKYLDYCTELTNVKVVPVGPPFQDPMTNDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGRVRDISKRLRARREEEMNAAAEELIQLCRNRNAYK

SEQ ID NO: 3583 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgtaattgaggctaagtacctggactattgcaccgaactgaccaatgtaaaagttgttccggttggtccgccatttcaggatccgatgaccgaggatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaatctgagagcgagacgcgaggaggaaatgaatgcagcggcggaagaactgatacagctgtgtcgcaaccgcaacgcctacaag

SEQ ID NO: 3584 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSRVIEAKYLDYCTELTNVKVVPVGPPFQDPMTEDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3585 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatccgcctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatattgacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgggaaagtacgcgacattagcaaaaatctgagagcgagacgcgaggaggaaatgaatgcagcggcggaagaactgatacagctgtgtcgcaaccgcaacgcctacaag

SEQ ID NO: 3586 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGVEFPFPAIRLSKREQVKMREMFEKEPDEEDPLAPGNGGIMLMCTSREIEAKYLDYCTELTNVKVVPVGPPFQDPMTNDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3587 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatccgcctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccgaggatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaatctgagagcgagacgcgaggaggaaatgaatgcagcggcggaagaactgatacagctgtgtcgcaaccgcaacgcctacaag

SEQ ID NO: 3588 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGVEFPFPAIRLSKREQVKMREMFEKEPDEEDPLAPGNGGIMLMCTSREIEAKYLDYCTELTNVKVVPVGPPFQDPMTEDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3589 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcgatccgcctgtcgaagcgagaacaggtgaagatgcgcgagatgtttgaaaaggagccggatgaagaagatccgttagcacctggcaatggcggtatcatgctgatgtgcacgagccgcgtaattgaggctaagtacctggactattgcaccgaactgaccaatgtaaaagttgttccggttggtccgccatttcaggatccgatgaccgaggatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgccgcaaagtacgcgacattagcaaaaatctgagagcgagacgcgaggaggaaatgaatgcagcggcggaagaactgatacagctgtgtcgcaaccgcaacgcctacaag

SEQ ID NO: 3590 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNGGIMLMCTSRVIEAKYLDYCTELTNVKVVPVGPPFQDPMTEDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRRKVRDISKNLRARREEEMNAAAEELIQLCRNRNAYK

SEQ ID NO: 3591 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttaactagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3592 - protein, 450 aa, Artificial Sequence
  "Variant of ADP-beta-1,2-glycosyltransferase"
MHHHHEGSSGQTLRVLMFPWLALGHINPFLRIAKQLADRGFLIYLTSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3593 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccatgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3594 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTMINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3595 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccccgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3596 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTPINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3597 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtctcgctagaacaggggatcccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3598 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVSLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3599 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttcctattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3600 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVPILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3601 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgctctagaacaggggatcccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3602 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVALEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3603 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccgctattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3604 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTAINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3605 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaacttgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3606 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLDTKPENSVVYVSFGSEYFLSREDMEELAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3607 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaacctgtcgaagcgagaacagactaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3608 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQTKMREMFEKEPDEEDPLAPGNGGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3609 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtacgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3610 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGTPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3611 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttagtgagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3612 - protein, 450 aa, Artificial Sequence
  "Variant of ADP-beta-1,2-glycosyltransferase"
MHHHHEGSSGQTLRVLMFPWLALGHINPFLRIAKQLADRGFLIYLVSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3613 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatggctaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3614 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMAKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3615 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtacccagattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3616 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTQINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3617 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcattatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3618 - protein, 450 aa, Artificial Sequence
  "Variant of ADP-beta-1,2-glycosyltransferase"
MHHHHEGSSGQTLRVLMFPWLALGHINPFLRIAKQLADRGFIIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3619 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaacctgtcgaagcgagaacaggataagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3620 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQDKMREMFEKEPDEEDPLAPGNGGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3621 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttttgtgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3622 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLDTKPENSVVYVSFGSEYFLSREDMEEVAFGLELSNVNFLWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3623 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaagatctggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3624 - protein, 450 aa, Artificial Sequence
  "Variant of ADP-beta-1,2-glycosyltransferase"
MHHHHEGSSGQTLRVLMFPWLALGHINPFLRIAKDLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3625 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttctttatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3626 - protein, 450 aa, Artificial Sequence
  "Variant of ADP-beta-1,2-glycosyltransferase"
MHHHHEGSSGQTLRVLMFPWLALGHINPFLRIAKQLADRGFFIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3627 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtctgtctagaacaggggatcccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3628 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVCLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3629 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtacctcgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3630 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTSINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3631 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacgtctgtgtcgcaaccgcaacgcctacaag

SEQ ID NO: 3632 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIRLCRNRNAYK

SEQ ID NO: 3633 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcgtgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3634 - protein, 450 aa, Artificial Sequence
  "Variant of ADP-beta-1,2-glycosyltransferase"
MHHHHEGSSGQTLRVLMFPWLALGHINPFLRIAKQLADRGFVIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3635 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttggggtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3636 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVGVEIVRDEDGRIHRGEIAQVLKDVITGETGEILRGKVRDISKNLRARREEEMNAAAEELIQLCRNRNAYK

SEQ ID NO: 3637 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcgttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3638 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVVKDVITGETGEILRGKVRDISKNLRARREEEMNAAAEELIQLCRNRNAYK

SEQ ID NO: 3639 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaaattgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3640 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLDTKPENSVVYVSFGSEYFLSREDMEEIAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3641 - DNA, 1350 bp, Artificial Sequence
  "Variant of ADP-beta-1,2-glycosyltransferase"
atgcaccatcatcatgaaggcagcagcggccagaccctgaaggtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3642 - protein, 450 aa, Artificial Sequence
  "Variant of ADP-beta-1,2-glycosyltransferase"
MHHHHEGSSGQTLKVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3643 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaattgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgcgtctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3644 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGETGEILRGKVRDISKNLRARREEEMNAAAEELIQLCRNRNAYK

SEQ ID NO: 3645 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgataattctgtgtcgcaaccgcaacgcctacaag

SEQ ID NO: 3646 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIILCRNRNAYK

SEQ ID NO: 3647 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccggcgacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3648 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPATGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3649 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaacctgtcgaagcgagaacaggtgaagcttcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3650 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKLREMFEKEPDEEDPLAPGNGGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3651 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaacctgtcgaagcgagaacaggctaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3652 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQAKMREMFEKEPDEEDPLAPGNGGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3653 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatctcatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattactggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3654 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFEKEPDEEDPLAPGNAGIMLMCTSRVIEAKYLDYCTELTNVKVVPVGPPFQDLMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3655 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttggaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatgtcatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcagcgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3656 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFGKEPDEEDPLAPGNAGIMLMCTSRVIEAKYLDYCTELTNVKVVPVGPPFQDVMTNDADDKELIDWLDTKPENSVVYVSFGSEYFLSREDMEEVAFGLELSSVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3657 - DNA, 1347 bp, Artificial Sequence
  "Variant of ADP-beta-1,2-glycosyltransferase"
atgcatcataatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcattcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttggaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatgtcatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattcaaggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3658 - protein, 449 aa, Artificial Sequence
  "Variant of ADP-beta-1,2-glycosyltransferase"
MHHNEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKIIQNLKPDLVLYDFLQPWAEQVVLEQGIPAVKILTSGAALFSYFFNFLKRPGHEFPFPAINLSKREQVKMREMFGKEPDEEDPLAPGNAGIMLMCTSRVIEAKYLDYCTELTNVKVVPVGPPFQDVMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVIQGETGEILRAKVRDISKNLRARREEEMNAAAEELIQLCRNRNAYK

SEQ ID NO: 3659 - DNA, 1350 bp, Artificial Sequence
  "Variant of ADP-beta-1,2-glycosyltransferase"
atgcaccatcataatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttggaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatgtcatgaccaatgatgcagacgacacagaactgattgattggttagataccaaacccataaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattcaaggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3660 - protein, 450 aa, Artificial Sequence
  "Variant of ADP-beta-1,2-glycosyltransferase"
MHHHNEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFGKEPDEEDPLAPGNAGIMLMCTSRVIEAKYLDYCTELTNVKVVPVGPPFQDVMTNDADDTELIDWLDTKPINSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVIQGETGEILRAKVRDISKNLRARREEEMNAAAEELIQLCRNRNAYK

SEQ ID NO: 3661 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttggaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatctcatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3662 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFGKEPDEEDPLAPGNAGIMLMCTSRVIEAKYLDYCTELTNVKVVPVGPPFQDLMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3663 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctagacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcattcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttggaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatctcatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaatggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3664 - protein, 450 aa, Artificial Sequence
  "Variant of ADP-beta-1,2-glycosyltransferase"
MHHHHEGSSGQTLRVLMFPWLALGHINPFLRIARQLADRGFLIYLCSTLINLESIKKRIPEKYSNSIHLVELHLPELPELPPHYHTTNGLPPHLNGTLHKALKMSAPNFSKIIQNLKPDLVLYDFLQPWAEQVVLEQGIPAVKILTSGAALFSYFFNFLKRPGHEFPFPAINLSKREQVKMREMFGKEPDEEDPLAPGNAGIMLMCTSRVIEAKYLDYCTELTNVKVVPVGPPFQDLMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVINGETGEILRAKVRDISKNLRARREEEMNAAAEELIQLCRNRNAYK

SEQ ID NO: 3665 - DNA, 1350 bp, Artificial Sequence
  "Variant of ADP-beta-1,2-glycosyltransferase"
atgcaccatcataatgaaggcagcagcggccagaccctgagagtactgatgtttccgtggcttgcgctgggtcatattaacccgtttttgcgtatcgctagacaactggccgatcgtggtttcctgatctatttatgcagtaccctgattaacctcgaaagcatcaaaaagagaatcccggagaaatacagtaatagcatccatctggttgagctggccctgccagaattaccggaactgccaccacattaccatactaccaacggtttaccaccgcatctgaacgggaccctgcacaaggcactgaagatgagcgctcccaactttagcaagatcattcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatcctatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaatggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3666 - protein, 450 aa, Artificial Sequence
  "Variant of ADP-beta-1,2-glycosyltransferase"
MHHHNEGSSGQTLRVLMFPWLALGHINPFLRIARQLADRGFLIYLCSTLINLESIKKRIPEKYSNSIHLVELALPELPELPPHYHTTNGLPPHLNGTLHKALKMSAPNFSKIIQNLKPDLVLYDFLQPWAEQVVLEQGIPAVKILTSGAALFSYFFNFLKRPGHEFPFPAINLSKREQVKMREMFEKEPDEEDPLAPGNAGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVINGETGEILRAKVRDISKNLRARREEEMNAAAEELIQLCRNRNAYK

SEQ ID NO: 3667 - DNA, 1350 bp, Artificial Sequence
  "Variant of ADP-beta-1,2-glycosyltransferase"
atgcaccatcataatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttggaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatgtcatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattcaaggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3668 - protein, 450 aa, Artificial Sequence
  "Variant of ADP-beta-1,2-glycosyltransferase"
MHHHNEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFGKEPDEEDPLAPGNAGIMLMCTSRVIEAKYLDYCTELTNVKVVPVGPPFQDVMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVIQGETGEILRAKVRDISKNLRARREEEMNAAAEELIQLCRNRNAYK

SEQ ID NO: 3669 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctggccctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatgtcatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3670 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELALPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFEKEPDEEDPLAPGNAGIMLMCTSRVIEAKYLDYCTELTNVKVVPVGPPFQDVMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3671 - DNA, 1350 bp, Artificial Sequence
  "Variant of ADP-beta-1,2-glycosyltransferase"
atgcaccatcataatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcattcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatgtcatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaatggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3672 - protein, 450 aa, Artificial Sequence
  "Variant of ADP-beta-1,2-glycosyltransferase"
MHHHNEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKIIQNLKPDLVLYDFLQPWAEQVVLEQGIPAVKILTSGAALFSYFFNFLKRPGHEFPFPAINLSKREQVKMREMFEKEPDEEDPLAPGNAGIMLMCTSRVIEAKYLDYCTELTNVKVVPVGPPFQDVMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVINGETGEILRAKVRDISKNLRARREEEMNAAAEELIQLCRNRNAYK

SEQ ID NO: 3673 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttggaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3674 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFGKEPDEEDPLAPGNAGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3675 - DNA, 1347 bp, Artificial Sequence
  "Variant of ADP-beta-1,2-glycosyltransferase"
atgcatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctggccctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttggaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatgtcatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3676 - protein, 449 aa, Artificial Sequence
  "Variant of ADP-beta-1,2-glycosyltransferase"
MHHHEGSSGQTLRVLMFPWLALGHINPFLRIAKQLADRGFLIYLCSTLINLESIKKRIPEKYSNSIHLVELALPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFGKEPDEEDPLAPGNAGIMLMCTSRVIEAKYLDYCTELTNVKVVPVGPPFQDVMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3677 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctggccctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttggaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatctcatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattcaaggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3678 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELALPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFGKEPDEEDPLAPGNAGIMLMCTSRVIEAKYLDYCTELTNVKVVPVGPPFQDLMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVIQGETGEILRAKVRDISKNLRARREEEMNAAAEELIQLCRNRNAYK

SEQ ID NO: 3679 - DNA, 1350 bp, Artificial Sequence
  "Variant of ADP-beta-1,2-glycosyltransferase"
atgcaccatcataatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccaatgatgcagacgacaaagaactgattgattggttagataccaaacccttaaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattcaaggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3680 - protein, 450 aa, Artificial Sequence
  "Variant of ADP-beta-1,2-glycosyltransferase"
MHHHNEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFEKEPDEEDPLAPGNAGIMLMCTSRVIEAKYLDYCTELTNVKVVPVGPPFQDPMTNDADDKELIDWLDTKPLNSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVIQGETGEILRAKVRDISKNLRARREEEMNAAAEELIQLCRNRNAYK

SEQ ID NO: 3681 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcattcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttggaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatcctatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattcaaggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3682 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKIIQNLKPDLVLYDFLQPWAEQVVLEQGIPAVKILTSGAALFSYFFNFLKRPGHEFPFPAINLSKREQVKMREMFGKEPDEEDPLAPGNAGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVIQGETGEILRAKVRDISKNLRARREEEMNAAAEELIQLCRNRNAYK

SEQ ID NO: 3683 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttggaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaatggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3684 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFGKEPDEEDPLAPGNAGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVINGETGEILRAKVRDISKNLRARREEEMNAAAEELIQLCRNRNAYK

SEQ ID NO: 3685 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttggaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattcaaggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3686 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFGKEPDEEDPLAPGNAGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVIQGETGEILRAKVRDISKNLRARREEEMNAAAEELIQLCRNRNAYK

SEQ ID NO: 3687 - DNA, 1350 bp, Artificial Sequence
  "Variant of ADP-beta-1,2-glycosyltransferase"
atgcaccatcataatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctggccctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttggaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaatggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3688 - protein, 450 aa, Artificial Sequence
  "Variant of ADP-beta-1,2-glycosyltransferase"
MHHHNEGSSGQTLRVLMFPWLALGHINPFLRIAKQLADRGFLIYLCSTLINLESIKKRIPEKYSNSIHLVELALPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFGKEPDEEDPLAPGNAGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVINGETGEILRAKVRDISKNLRARREEEMNAAAEELIQLCRNRNAYK

SEQ ID NO: 3689 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcagaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaaaaggagtcggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcttagaacgcgttggtgatcgtggtcgcgttctggaccatctggtgccgcaggcccatattctgcaccatccgagcacgggtggcttcatctctcattgcggttggaacagcgtcatggaaagcattgatgcgggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcaaaagtacgcgacattcagaaaaatctgagagcgagacgcgaggaggaaatgaatgcagcggcggaagaactgatacagctgtgtcgcaaccgcaacgcctacaag

SEQ ID NO: 3690 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFEKESDEEDPLAPGNAGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILHHPSTGGFISHCGWNSVMESIDAGVPIIAMPMQWDQPINAKLIVELGVAVEIVRDEDGRIHRGEIAQVLKDVITGETGEILRAKVRDIQKNLRARREEEMNAAAEELIQLCRNRNAYK

SEQ ID NO: 3691 - DNA, 1350 bp, Artificial Sequence
  "Variant of ADP-beta-1,2-glycosyltransferase"
atgtcccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagccaggtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatgcgggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcaagagtacgcgacattagtagaaatctgagagcgagacgcgaggaggaaatgaatgcagcggcggaagaactgatacagctgtgtcgcaaccgcaacgcctacaag

SEQ ID NO: 3692 - protein, 450 aa, Artificial Sequence
  "Variant of ADP-beta-1,2-glycosyltransferase"
MSHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFEKEPDEEDPLAPGNAGIMLMCTSRVIEAKYLDYCTELTNVKVVPVGPPFQDPMTNDADDKELIDWLDTKPENSVVYVSFGSEYFLSREDMEEVAFGLELSQVNFIWVARFPKGEEQNLEDVLPKGFLERVGDRGRVLDHLVPQAHILNHPSTGGFISHCGWNSVMESIDAGVPIIAMPMQWDQPINAKLIVELGVAVEIVRDEDGRIHRGEIAQVLKDVITGETGEILRARVRDISRNLRARREEEMNAAAEELIQLCRNRNAYK

SEQ ID NO: 3693 - DNA, 1350 bp, Artificial Sequence
  "Variant of ADP-beta-1,2-glycosyltransferase"
atgtcccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcagaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaaaaggagtcggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagccaggtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcaaaagtacgcgacattagtaaaaatctgagagcgagacgcgaggaggaaatgaatgcagcggcggaagaactgatacagctgtgtcgcaaccgcaacgcctacaag

SEQ ID NO: 3694 - protein, 450 aa, Artificial Sequence
  "Variant of ADP-beta-1,2-glycosyltransferase"
MSHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFEKESDEEDPLAPGNAGIMLMCTSRVIEAKYLDYCTELTNVKVVPVGPPFQDPMTNDADDKELIDWLDTKPENSVVYVSFGSEYFLSREDMEEVAFGLELSQVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3695 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3696 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 3697 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttatggatccgatgaccgaagatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3698 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFEKEPDEEDPLAPGNAGIMLMCTSRVIEAKYLDYCTELTNVKVVPVGPPFMDPMTEDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 3699 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttatggatccgatggccgaagatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgagactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3700 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFMDPMAEDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3701 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatggccgaagatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggatcatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3702 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMAEDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3703 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatggccaacgatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggatcatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgagactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3704 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFEKEPDEEDPLAPGNAGIMLMCTSRVIEAKYLDYCTELTNVKVVPVGPPFQDPMANDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3705 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatggccgaagatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3706 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFEKEPDEEDPLAPGNAGIMLMCTSRVIEAKYLDYCTELTNVKVVPVGPPFQDPMAEDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3707 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttatggatccgatgaccgaagatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3708 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFMDPMTEDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3709 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagtatcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3710 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVEYHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3711 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatggccgaagatatcgacgacaaagaactgattgattggttagataccaaaccctcaaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctgcctcatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgagactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3712 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFEKEPDEEDPLAPGNAGIMLMCTSRVIEAKYLDYCTELTNVKVVPVGPPFQDPMAEDIDDKELIDWLDTKPSNSVVYVSFGSEYFLSREDMEEVAFGLELSNVNFIWVARFPKGEEQNLEDVLPKGFLERVGDRGRVLPHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3713 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaaccctcaaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggatcatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgagactggtgagatcctgcgcgcgaaagtacgcgacattagcaaaaacctgagagcgagacgcgaggaggaaatgaatgcagcggcggaaactctgatacagctgtgtcgcaaccgcaacgcctacaag

SEQ ID NO: 3714 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFEKEPDEEDPLAPGNAGIMLMCTSRVIEAKYLDYCTELTNVKVVPVGPPFQDPMTEDIDDKELIDWLDTKPSNSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAETLIQLCRNRNAYK

SEQ ID NO: 3715 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggggccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccaacgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctgcctcatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgagactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3716 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKGPDEEDPLAPGNAGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLPHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3717 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttatggatccgatgaccgaagatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctgcctcatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgagactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3718 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFEKEPDEEDPLAPGNAGIMLMCTSRVIEAKYLDYCTELTNVKVVPVGPPFMDPMTEDADDKELIDWLDTKPENSVVYVSFGSEYFLSREDMEEVAFGLELSNVNFIWVARFPKGEEQNLEDVLPKGFLERVGDRGRVLPHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3719 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccaacgatatcgacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggatcatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3720 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFEKEPDEEDPLAPGNAGIMLMCTSRVIEAKYLDYCTELTNVKVVPVGPPFQDPMTNDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 3721 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatggccgaagatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggatcatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3722 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFEKEPDEEDPLAPGNAGIMLMCTSRVIEAKYLDYCTELTNVKVVPVGPPFQDPMAEDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 3723 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccaacgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3724 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3725 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatggccgaagatatcgacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggatcatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgagactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3726 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMAEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3727 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatggccaacgatatcgacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggatcatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3728 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFEKEPDEEDPLAPGNAGIMLMCTSRVIEAKYLDYCTELTNVKVVPVGPPFQDPMANDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 3729 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagtatcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttatggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggatcatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgagactggtgagatcctgcgcgcgaaagtacgcgacattagcaaaaacctgagagcgagacgcgaggaggaaatgaatgcagcggcggaaactctgatacagctgtgtcgcaaccgcaacgcctacaag

SEQ ID NO: 3730 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVEYPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFMDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAETLIQLCRNRNAYK

SEQ ID NO: 3731 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttatggatccgatggccgaagatgcggacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3732 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFEKEPDEEDPLAPGNAGIMLMCTSRVIEAKYLDYCTELTNVKVVPVGPPFMDPMAEDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3733 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3734 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3735 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttatggatccgatgaccgaagatatcgacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgagactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3736 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFEKEPDEEDPLAPGNAGIMLMCTSRVIEAKYLDYCTELTNVKVVPVGPPFMDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3737 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatggccgaagatatcgacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctgcctcatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3738 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMAEDIDDKELIDWLDTKPENSVVYVSFGSEYFLSREDMEEVAFGLELSNVNFIWVARFPKGEEQNLEDVLPKGFLERVGDRGRVLPHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 3739 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttatggatccgatggccaacgatatcgacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggatcatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3740 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFMDPMANDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3741 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttatggatccgatgaccaacgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggatcatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgagactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3742 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFMDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3743 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatggccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctgcctcatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3744 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFEKEPDEEDPLAPGNAGIMLMCTSRVIEAKYLDYCTELTNVKVVPVGPPFQDPMAEDIDDKELIDWLDTKPENSVVYVSFGSEYFLSREDMEEVAFGLELSNVNFIWVARFPKGEEQNLEDVLPKGFLERVGDRGRVLPHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 3745 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatgcggacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggatcatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3746 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 3747 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagtatcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatggccgaagatatcgacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggatcatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3748 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVEYHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMAEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 3749 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttatggatccgatggccaacgatgcggacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggatcatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3750 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFMDPMANDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 3751 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatgcggacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgcagaacagaatctggaagacgttctgccaaaaggcttcctggaacgcgttggtgatcgtggtcgcgttctgcctcatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgagactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3752 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDADDKELIDWLDTKPENSVVYVSFGSEYFLSREDMEEVAFGLELSNVNFIWVARFPKGAEQNLEDVLPKGFLERVGDRGRVLPHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3753 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttatggatccgatgaccgaagatatcgacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaaactctgatacagctgtgtcgcaaccgcaacgcctacaag

SEQ ID NO: 3754 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFMDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAETLIQLCRNRNAYK

SEQ ID NO: 3755 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatgcggacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgagactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3756 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3757 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttatggatccgatggccgaagatatcgacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgagactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3758 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFMDPMAEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3759 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcacctggcgccactggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3760 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRFNFLSTPGVEFPFPAINLSKREQVKMREMFEKEPDEEDPLAPGATGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3761 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgctgagctaccgcttcaacttcctgtctactccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3762 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALLSYRFNFLSTPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3763 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcagatggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3764 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRFNFLSTPGVEFPFPAINLSKREQVKMREMFEKEPDEEDPLADGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3765 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcacagggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3766 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRFNFLSTPGVEFPFPAINLSKREQVKMREMFEKEPDEEDPLAQGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3767 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcacctggcgccggaggttggatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3768 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRFNFLSTPGVEFPFPAINLSKREQVKMREMFEKEPDEEDPLAPGAGGWMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3769 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttcatattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3770 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVHILTSGAALFSYRFNFLSTPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3771 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaatcggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3772 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRFNFLSTPGVEFPFPAINLSKREQVKMREMFESEPDEEDPLAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3773 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgcgggcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3774 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRFNFLSTPGVEFPFPAINLSKREQVKMREMFEKEPDEEDPRAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3775 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgtatgcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3776 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRFNFLSTPGVEFPFPAINLSKREQVKMREMFEKEPDEEDPYAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3777 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcacctggcgccggatggatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3778 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRFNFLSTPGVEFPFPAINLSKREQVKMREMFEKEPDEEDPLAPGAGWIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3779 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaacagttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3780 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRFNFLSTPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSFGSEQFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3781 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaatgccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3782 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLMPHLNGTLHKALKMSKPNFSKILQNLKPDLVLYDFQQAWAEQVVLEQGIPAVKILTSGAALFSYRFNFLSTPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3783 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcacctggcgccccgggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3784 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRFNFLSTPGVEFPFPAINLSKREQVKMREMFEKEPDEEDPLAPGAPGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3785 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcatggggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3786 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRFNFLSTPGVEFPFPAINLSKREQVKMREMFEKEPDEEDPLAWGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3787 - DNA, 1350 bp, Artificial Sequence
  "Variant of ADP-beta-1,2-glycosyltransferase"
atgcaccatcatcatgaaggcggtagcggccagaccctgagagtactgatgtttccgtggatggcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3788 - protein, 450 aa, Artificial Sequence
  "Variant of ADP-beta-1,2-glycosyltransferase"
MHHHHEGGSGQTLRVLMFPWMALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRFNFLSTPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3789 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcacctggcgccgagggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3790 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRFNFLSTPGVEFPFPAINLSKREQVKMREMFEKEPDEEDPLAPGAEGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3791 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattgtcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3792 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDCQQAWAEQVVLEQGIPAVKILTSGAALFSYRFNFLSTPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3793 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagggggcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3794 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQGAWAEQVVLEQGIPAVKILTSGAALFSYRFNFLSTPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3795 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcacctggcgccggaaggatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3796 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRFNFLSTPGVEFPFPAINLSKREQVKMREMFEKEPDEEDPLAPGAGRIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3797 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccagacctggtcctttacgattttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtctggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3798 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRFNFLSTPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSSGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3799 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttccgattctaaccagtggtgcgtcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3800 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVPILTSGASLFSYRFNFLSTPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3801 - DNA, 1350 bp, Artificial Sequence
  "Variant of ADP-beta-1,2-glycosyltransferase"
atgcaccatcatcatgaaggcggtagcggccagaccctgagagtactgatgtttccgtggcctgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3802 - protein, 450 aa, Artificial Sequence
  "Variant of ADP-beta-1,2-glycosyltransferase"
MHHHHEGGSGQTLRVLMFPWPALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRFNFLSTPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3803 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtggacagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaacaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3804 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWTEQVVLEQGIPAVKILTSGAALFSYRFNFLSTPGVEFPFPAINLSKREQVKMREMFEQEPDEEDPLAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3805 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcacctggcgccggaggtgcgatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3806 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRFNFLSTPGVEFPFPAINLSKREQVKMREMFEKEPDEEDPLAPGAGGAMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3807 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgtgaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3808 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRFNFLSTPGVEFPFPAINLSKREQVKMREMFVKEPDEEDPLAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3809 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcacctggcgccggagcgatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3810 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRFNFLSTPGVEFPFPAINLSKREQVKMREMFEKEPDEEDPLAPGAGAIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3811 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgagtgcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3812 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRFNFLSTPGVEFPFPAINLSKREQVKMREMFEKEPDEEDPSAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3813 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgacgggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3814 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRFNFLSTPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSTGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3815 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcacctggcgcccggggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3816 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRFNFLSTPGVEFPFPAINLSKREQVKMREMFEKEPDEEDPLAPGARGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3817 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgccagaacttcctgtctactccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3818 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRQNFLSTPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3819 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgtggcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3820 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRFNFLSTPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPWQWDQPINAKLIVELGVAVEIVRDEDGRIHRGEIAQVLKDVITGETGEILRGKVRDISKNLRARREEEMNAAAEELIQLCRNRNKYK

SEQ ID NO: 3821 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgggtgcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3822 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRFNFLSTPGVEFPFPAINLSKREQVKMREMFEKEPDEEDPGAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3823 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttaataaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3824 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRFNFLSTPGVEFPFPAINLSKREQVKMREMFNKEPDEEDPLAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3825 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaatttggaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3826 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKIWTSGAALFSYRFNFLSTPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3827 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgctgtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3828 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRFNFLSTPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMLWDQPINAKLIVELGVAVEIVRDEDGRIHRGEIAQVLKDVITGETGEILRGKVRDISKNLRARREEEMNAAAEELIQLCRNRNKYK

SEQ ID NO: 3829 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcacctggcgccggatctatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3830 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRFNFLSTPGVEFPFPAINLSKREQVKMREMFEKEPDEEDPLAPGAGSIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3831 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatggttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3832 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRFNFLSTPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSFGSEWFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3833 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgacggcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3834 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRFNFLSTPGVEFPFPAINLSKREQVKMREMFEKEPDEEDPTAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3835 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgatatgcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3836 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDMQQAWAEQVVLEQGIPAVKILTSGAALFSYRFNFLSTPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3837 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgtcgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3838 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRFNFLSTPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPSQWDQPINAKLIVELGVAVEIVRDEDGRIHRGEIAQVLKDVITGETGEILRGKVRDISKNLRARREEEMNAAAEELIQLCRNRNKYK

SEQ ID NO: 3839 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatttttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3840 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRFNFLSTPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSFGSEFFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3841 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgacaaagtacgcgacattagcaaaaacctgagagcgagacgcgaggaggaaatgaatgcagcggcggaagaactgatacagctgtgtcgcaaccgcaacaagtacaag

SEQ ID NO: 3842 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRFNFLSTPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRDKVRDISKNLRARREEEMNAAAEELIQLCRNRNKYK

SEQ ID NO: 3843 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgatgttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3844 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDVQQAWAEQVVLEQGIPAVKILTSGAALFSYRFNFLSTPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3845 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgtttgcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3846 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRFNFLSTPGVEFPFPAINLSKREQVKMREMFEKEPDEEDPFAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3847 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcccgaacttcctgtctactccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3848 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRPNFLSTPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3849 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcattgggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3850 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRFNFLSTPGVEFPFPAINLSKREQVKMREMFEKEPDEEDPLALGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3851 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttcggaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3852 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFRKEPDEEDPLAPGNAGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3853 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaaacggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3854 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFETEPDEEDPLAPGNAGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3855 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaaaaggagccggatgaagaagatccgttagcacctggctatgccggtatcatgctgatgtgcacgagccgcgtaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3856 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFEKEPDEEDPLAPGYAGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3857 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacatgtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3858 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEHVVLEQGIPAVKILTSGAALFSYFFNFLKRPGHEFPFPAINLSKREQVKMREMFEKEPDEEDPLAPGNAGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3859 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttgggtactttttcaacttcctgaagcgaccgggtcacgagtttccgtttccggcaatcaatctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3860 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFGYFFNFLKRPGHEFPFPAINLSKREQVKMREMFEKEPDEEDPLAPGNAGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3861 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaaactgtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3862 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAETVVLEQGIPAVKILTSGAALFSYFFNFLKRPGHEFPFPAINLSKREQVKMREMFEKEPDEEDPLAPGNAGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3863 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaaaaggagccggatgaagaagatccgttatcgcctggcaatgccggtatcatgctgatgtgcacgagccgcgtaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3864 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFEKEPDEEDPLSPGNAGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3865 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttgcgtactttttcaacttcctgaagcgaccgggtcacgagtttccgtttccggcaatcaatctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3866 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFAYFFNFLKRPGHEFPFPAINLSKREQVKMREMFEKEPDEEDPLAPGNAGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3867 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctggttccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3868 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLVPWAEQVVLEQGIPAVKILTSGAALFSYFFNFLKRPGHEFPFPAINLSKREQVKMREMFEKEPDEEDPLAPGNAGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3869 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaaaaggagccggatgaagaagatccgttagcacctggcgctgccggtatcatgctgatgtgcacgagccgcgtaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3870 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFEKEPDEEDPLAPGAAGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3871 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaagttctaaccagtggtgcggcactgtttagctactttttcaacttcctgaagcgaccgggtcacgagtttccgtttccggcaatcaatctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3872 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKVLTSGAALFSYFFNFLKRPGHEFPFPAINLSKREQVKMREMFEKEPDEEDPLAPGNAGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3873 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgctaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3874 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFAKEPDEEDPLAPGNAGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3875 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaagctgagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3876 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFEAEPDEEDPLAPGNAGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3877 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgttgccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3878 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLLPWAEQVVLEQGIPAVKILTSGAALFSYFFNFLKRPGHEFPFPAINLSKREQVKMREMFEKEPDEEDPLAPGNAGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3879 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaaaaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3880 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEKVVLEQGIPAVKILTSGAALFSYFFNFLKRPGHEFPFPAINLSKREQVKMREMFEKEPDEEDPLAPGNAGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3881 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacccgaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3882 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNPTLHKALKMSAPNFSKILQNLKPDLVLYDFLQPWAEQVVLEQGIPAVKILTSGAALFSYFFNFLKRPGHEFPFPAINLSKREQVKMREMFEKEPDEEDPLAPGNAGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3883 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaacgtgagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3884 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFEREPDEEDPLAPGNAGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3885 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaaaaggagccggatgaagaagatccgttagcacctggctctgccggtatcatgctgatgtgcacgagccgcgtaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3886 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFEKEPDEEDPLAPGSAGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3887 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgggaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3888 - protein, 450 aa, Artificial Sequence; identical to SEQ ID NO: 3674
  "Variant of ADP-beta-1,2-glycosyltransferase"

SEQ ID NO: 3889 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgcgaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3890 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNATLHKALKMSAPNFSKILQNLKPDLVLYDFLQPWAEQVVLEQGIPAVKILTSGAALFSYFFNFLKRPGHEFPFPAINLSKREQVKMREMFEKEPDEEDPLAPGNAGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3891 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaaaaggagccggatgaagaagatccgttagcacctggcaattctggtatcatgctgatgtgcacgagccgcgtaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3892 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAINLSKREQVKMREMFEKEPDEEDPLAPGNSGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3893 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctacttttggaacttcctgaagcgaccgggtcacgagtttccgtttccggcaatcaatctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3894 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYFWNFLKRPGHEFPFPAINLSKREQVKMREMFEKEPDEEDPLAPGNAGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3895 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgattccgtgggcagaacaggtcgtgctagaacaggggatcccggctgttaaaattctaaccagtggtgcggcactgtttagctactttttcaacttcctgaagcgaccgggtcacgagtttccgtttccggcaatcaatctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3896 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLIPWAEQVVLEQGIPAVKILTSGAALFSYFFNFLKRPGHEFPFPAINLSKREQVKMREMFEKEPDEEDPLAPGNAGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3897 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctacatgttcaacttcctgaagcgaccgggtcacgagtttccgtttccggcaatcaatctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccaatgatgcagacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3898 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSAPNFSKILQNLKPDLVLYDFLQPWAEQVVLEQGIPAVKILTSGAALFSYMFNFLKRPGHEFPFPAINLSKREQVKMREMFEKEPDEEDPLAPGNAGIMLMCTSRVIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3899 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccctaattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3900 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTLINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 3901 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcgttatctatttagttagtaccccaattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtctgcctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcgggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatgccggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcgtgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3902 - protein, 450 aa, Artificial Sequence
  "Variant of ADP-beta-1,2-glycosyltransferase"
MHHHHEGSSGQTLRVLMFPWLALGHINPFLRIAKQLADRGFVIYLVSTPINLESIKKRIPEKYSNSIHLVELPLPELPELPPHYHTTNGLPPHLNGTLHKALKMSAPNFSKILQNLKPDLVLYDFLQPWAEQVCLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFRDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDAGVPIIAMPMQWDQPINAKLIVELGVAVEIVRDEDGRIHRGEIAQVVKDVITGPTGEILRAKVRDISKNLRARREEEMNAAAEELIQLCRNRNAYK

SEQ ID NO: 3903 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcattatctatttagttagtacctctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtctgcctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttggaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3904 - protein, 450 aa, Artificial Sequence
  "Variant of ADP-beta-1,2-glycosyltransferase"
MHHHHEGSSGQTLRVLMFPWLALGHINPFLRIAKQLADRGFIIYLVSTSINLESIKKRIPEKYSNSIHLVELPLPELPELPPHYHTTNGLPPHLNGTLHKALKMSAPNFSKILQNLKPDLVLYDFLQPWAEQVCLEQGIPAVKILTSGAALFSYFFNFLKRPGHEFPFPAIRLSKREQVKMREMFGKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 3905 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttccttatctatttatgtagtacccaaattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3906 - protein, 450 aa, Artificial Sequence
  "Variant of ADP-beta-1,2-glycosyltransferase"
MHHHHEGSSGQTLRVLMFPWLALGHVNPFLRIAKQLADRGFLIYLCSTQINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 3907 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttccttatctatttagttagtacccaaattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcaccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3908 - protein, 450 aa, Artificial Sequence
  "Variant of ADP-beta-1,2-glycosyltransferase"
MHHHHEGSSGQTLRVLMFPWLALGHINPFLRIAKQLADRGFLIYLVSTQINLESIKKRIPEKYSNSIHLVELPLPELPELPPHYHTTNGLPPHLNGTLHKALKMSAPNFSKILQNLKPDLVLYDFLQPWAEQVTLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 3909 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcaccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcgtgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3910 - protein, 450 aa, Artificial Sequence
  "Variant of ADP-beta-1,2-glycosyltransferase"
MHHHHEGSSGQTLRVLMFPWLALGHVNPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVTLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVVKDVITGPTGEILRAKVRDISKNLRARREEEMNAAAEELIQLCRNRNAYK

SEQ ID NO: 3911 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttatgtagtaccctaattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtctgcctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcgtgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3912 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLCSTLINLESIKKRIPEKYSNSIHLVELPLPELPELPPHYHTTNGLPPHLNGTLHKALKMSAPNFSKILQNLKPDLVLYDFLQPWAEQVCLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVVKDVITGPTGEILRAKVRDISKNLRARREEEMNAAAEELIQLCRNRNAYK

SEQ ID NO: 3913 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcgtgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3914 - protein, 450 aa, Artificial Sequence
  "Variant of ADP-beta-1,2-glycosyltransferase"
MHHHHEGSSGQTLRVLMFPWLALGHINPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVVKDVITGPTGEILRAKVRDISKNLRARREEEMNAAAEELIQLCRNRNAYK

SEQ ID NO: 3915 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcattatctatttatgtagtacccaaattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtctgcctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttggaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatgccggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3916 - protein, 450 aa, Artificial Sequence
  "Variant of ADP-beta-1,2-glycosyltransferase"
MHHHHEGSSGQTLRVLMFPWLALGHVNPFLRIAKQLADRGFIIYLCSTQINLESIKKRIPEKYSNSIHLVELPLPELPELPPHYHTTNGLPPHLNGTLHKALKMSAPNFSKILQNLKPDLVLYDFLQPWAEQVCLEQGIPAVKILTSGAALFSYFFNFLKRPGHEFPFPAIRLSKREQVKMREMFGKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDAGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 3917 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcattatctatttatgtagtacccaaattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtctgcctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcgtgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3918 - protein, 450 aa, Artificial Sequence
  "Variant of ADP-beta-1,2-glycosyltransferase"
MHHHHEGSSGQTLRVLMFPWLALGHVNPFLRIAKQLADRGFIIYLCSTQINLESIKKRIPEKYSNSIHLVELPLPELPELPPHYHTTNGLPPHLNGTLHKALKMSAPNFSKILQNLKPDLVLYDFLQPWAEQVCLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVVKDVITGPTGEILRAKVRDISKNLRARREEEMNAAAEELIQLCRNRNAYK

SEQ ID NO: 3919 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttatgtagtacctctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtctgcctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3920 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLCSTSINLESIKKRIPEKYSNSIHLVELPLPELPELPPHYHTTNGLPPHLNGTLHKALKMSAPNFSKILQNLKPDLVLYDFLQPWAEQVCLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 3921 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcgttatctatttatgtagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtctgcctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttggaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatgccggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3922 - protein, 450 aa, Artificial Sequence
  "Variant of ADP-beta-1,2-glycosyltransferase"
MHHHHEGSSGQTLRVLMFPWLALGHINPFLRIAKQLADRGFVIYLCSTAINLESIKKRIPEKYSNSIHLVELPLPELPELPPHYHTTNGLPPHLNGTLHKALKMSAPNFSKILQNLKPDLVLYDFLQPWAEQVCLEQGIPAVKILTSGAALFSYFFNFLKRPGHEFPFPAIRLSKREQVKMREMFGKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDAGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 3923 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtctgcctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttggaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3924 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVCLEQGIPAVKILTSGAALFSYFFNFLKRPGHEFPFPAIRLSKREQVKMREMFGKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 3925 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcgttatctatttagttagtacctctattaacctcgaaagcatcaaaaagagaatcccggagaaatacagtaatagcatccatctggttgagctgcctctgccagaattaccggaactgccaccacattaccatactaccaacggtttaccaccgcatctgaacgggcccctgcacaaggcactgaagatgagcgctcccaactttagcaagatcctgcaaaacctgaagccggacctggtcctttacgattttctgcaaccgtgggcagaacaggtctgcctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcgtgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3926 - protein, 450 aa, Artificial Sequence
  "Variant of ADP-beta-1,2-glycosyltransferase"
MHHHHEGSSGQTLRVLMFPWLALGHINPFLRIAKQLADRGFVIYLVSTSINLESIKKRIPEKYSNSIHLVELPLPELPELPPHYHTTNGLPPHLNGPLHKALKMSAPNFSKILQNLKPDLVLYDFLQPWAEQVCLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVVKDVITGPTGEILRAKVRDISKNLRARREEEMNAAAEELIQLCRNRNAYK

SEQ ID NO: 3927 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcaccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttggaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatgccggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3928 - protein, 450 aa, Artificial Sequence
  "Variant of ADP-beta-1,2-glycosyltransferase"
MHHHHEGSSGQTLRVLMFPWLALGHINPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVTLEQGIPAVKILTSGAALFSYFFNFLKRPGHEFPFPAIRLSKREQVKMREMFGKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDAGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 3929 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttggaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatgccggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcgtgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3930 - protein, 450 aa, Artificial Sequence
  "Variant of ADP-beta-1,2-glycosyltransferase"
MHHHHEGSSGQTLRVLMFPWLALGHVNPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFGKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDAGVPIIAMPMQWDQPINAKLIVELGVAVEIVRDEDGRIHRGEIAQVVKDVITGPTGEILRAKVRDISKNLRARREEEMNAAAEELIQLCRNRNAYK

SEQ ID NO: 3931 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcattatctatttagttagtacctctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttggaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3932 - protein, 450 aa, Artificial Sequence
  "Variant of ADP-beta-1,2-glycosyltransferase"
MHHHHEGSSGQTLRVLMFPWLALGHINPFLRIAKQLADRGFIIYLVSTSINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFGKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 3933 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtcctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3934 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 3935 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcctgatctatttatgcagtaccctaattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatgccggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcgtgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3936 - protein, 450 aa, Artificial Sequence
  "Variant of ADP-beta-1,2-glycosyltransferase"
MHHHHEGSSGQTLRVLMFPWLALGHVNPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDAGVPIIAMPMQWDQPINAKLIVELGVAVEIVRDEDGRIHRGEIAQVVKDVITGPTGEILRAKVRDISKNLRARREEEMNAAAEELIQLCRNRNAYK

SEQ ID NO: 3937 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcgttatctatttatgtagtaccctaattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtctgcctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttggaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3938 - protein, 450 aa, Artificial Sequence
  "Variant of ADP-beta-1,2-glycosyltransferase"
MHHHHEGSSGQTLRVLMFPWLALGHINPFLRIAKQLADRGFVIYLCSTLINLESIKKRIPEKYSNSIHLVELPLPELPELPPHYHTTNGLPPHLNGTLHKALKMSAPNFSKILQNLKPDLVLYDFLQPWAEQVCLEQGIPAVKILTSGAALFSYFFNFLKRPGHEFPFPAIRLSKREQVKMREMFGKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 3939 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcattatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3940 - protein, 450 aa, Artificial Sequence
  "Variant of ADP-beta-1,2-glycosyltransferase"
MHHHHEGSSGQTLRVLMFPWLALGHINPFLRIAKQLADRGFIIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 3941 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcgttatctatttatgtagtacctctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttggaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcgtgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3942 - protein, 450 aa, Artificial Sequence
  "Variant of ADP-beta-1,2-glycosyltransferase"
MHHHHEGSSGQTLRVLMFPWLALGHINPFLRIAKQLADRGFVIYLCSTSINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFGKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVVKDVITGPTGEILRAKVRDISKNLRARREEEMNAAAEELIQLCRNRNAYK

SEQ ID NO: 3943 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgtagtaccctaattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttggaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatgccggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3944 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFGKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDAGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 3945 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttatgtagtaccctaattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcactggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3946 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 3947 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtctgcctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcgtgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3948 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVCLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVVKDVITGPTGEILRAKVRDISKNLRARREEEMNAAAEELIQLCRNRNAYK

SEQ ID NO: 3949 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcgttatctatttatgtagtacctctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtctgcctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatgccggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcgtgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3950 - protein, 450 aa, Artificial Sequence
  "Variant of ADP-beta-1,2-glycosyltransferase"
MHHHHEGSSGQTLRVLMFPWLALGHINPFLRIAKQLADRGFVIYLCSTSINLESIKKRIPEKYSNSIHLVELPLPELPELPPHYHTTNGLPPHLNGTLHKALKMSAPNFSKILQNLKPDLVLYDFLQPWAEQVCLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDAGVPIIAMPMQWDQPINAKLIVELGVAVEIVRDEDGRIHRGEIAQVVKDVITGPTGEILRAKVRDISKNLRARREEEMNAAAEELIQLCRNRNAYK

SEQ ID NO: 3951 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttccttatctatttatgtagtaccctaattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3952 - protein, 450 aa, Artificial Sequence
  "Variant of ADP-beta-1,2-glycosyltransferase"
MHHHHEGSSGQTLRVLMFPWLALGHVNPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 3953 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtctgcctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatgccggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3954 - protein, 450 aa, Artificial Sequence
  "Variant of ADP-beta-1,2-glycosyltransferase"
MHHHHEGSSGQTLRVLMFPWLALGHVNPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVCLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDAGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 3955 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3956 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 3957 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttccttatctatttatgtagtacctctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtctgcctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatgccggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3958 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTSINLESIKKRIPEKYSNSIHLVELPLPELPELPPHYHTTNGLPPHLNGTLHKALKMSAPNFSKILQNLKPDLVLYDFLQPWAEQVCLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDAGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 3959 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcgttatctatttatgtagtaccctaattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtcctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttggaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatgccggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3960 - protein, 450 aa, Artificial Sequence
  "Variant of ADP-beta-1,2-glycosyltransferase"
MHHHHEGSSGQTLRVLMFPWLALGHINPFLRIAKQLADRGFVIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFGKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDAGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 3961 - DNA, 1347 bp, Artificial Sequence
  "Variant of ADP-beta-1,2-glycosyltransferase"
atgcatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgtcggctcccaactttagcaagatcctgcaaaacctgaagccggacctggtcctttacgattttctgcaaccgtgggcagaacaggtcgtgctagaacaggggatcccggctgttccgattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtacgccatttcaggatccaatgaccgaagatatcgacgacaaagaactgattgattggttagataccaaacccgaaaacagtgttgtctatgtgtcgtttggcagcgaatacttcctgagccgtgaagatatggaagaagttgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacatttctaaaaacctgagagcgagacgcgaggaggaaatgaatgcagcggcggaagaactgatacggctgtgtcgcaaccgcaacgcctacaag

SEQ ID NO: 3962 - protein, 449 aa, Artificial Sequence
  "Variant of ADP-beta-1,2-glycosyltransferase"
MHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVPILTSGAALFSYFFNFLKRPGHEFPFPAIRLSKREQVKMREMFEKEPDEEDPLAPGNAGIMLMCTSRVIEAKYLDYCTELTNVKVVPVGTPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKNLRARREEEMNAAAEELIRLCRNRNAYK

SEQ ID NO: 3963 - DNA, 1347 bp, Artificial Sequence
  "Variant of ADP-beta-1,2-glycosyltransferase"
atgcatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttccgattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacggctgtgtcgcaaccgcaacgcctacaag

SEQ ID NO: 3964 - protein, 449 aa, Artificial Sequence
  "Variant of ADP-beta-1,2-glycosyltransferase"
MHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVPILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKNLRARREEEMNAAAEELIRLCRNRNAYK

SEQ ID NO: 3965 - DNA, 1350 bp, Artificial Sequence
  "Variant of ADP-beta-1,2-glycosyltransferase"
atgcaccatcataatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaagattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatttgatgaccgaagatatcgacgacaaagaactgattgattggttagataccaaacccgaaaacagtgttgtctatgtgtcgtttggcagcgaatacttcctgagccgtgaagatatggaagaagttgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacatttctagaaacctgagagcgagacgcgaggaggaaatgaatgcagcggcggaagaactgatacagctgtgtcgcaaccgcaacgcctacaag

SEQ ID NO: 3966 - protein, 450 aa, Artificial Sequence
  "Variant of ADP-beta-1,2-glycosyltransferase"
MHHHNEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDLMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISRNLRARREEEMNAAAEELIQLCRNRNAYK

SEQ ID NO: 3967 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatggcggctcccaactttagcaagatcctgcaaaacctgaagccggacctggtcctttacgattttctgcaaccgtgggcagaacaggtcgtgctagaacaggggatcccggctgttaagattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacggctgtgtcgcaaccgcaacgcctacaag

SEQ ID NO: 3968 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMAAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKNLRARREEEMNAAAEELIRLCRNRNAYK

SEQ ID NO: 3969 - DNA, 1350 bp, Artificial Sequence
  "Variant of ADP-beta-1,2-glycosyltransferase"
atgcaccatcataatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttccgattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagtcggatgaagaagatccgttagcacctggcaatgccggtatcatgctgatgtgcacgagccgcgtaattgaggctaagtacctggactattgcaccgaactgaccaatgtaaaagttgttccggttggtacgccatttcaggatgtgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacggctgtgtcgcaaccgcaacgcctacaag

SEQ ID NO: 3970 - protein, 450 aa, Artificial Sequence
  "Variant of ADP-beta-1,2-glycosyltransferase"
MHHHNEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVPILTSGAALFSYFFNFLKRPGHEFPFPAIRLSKREQVKMREMFEKESDEEDPLAPGNAGIMLMCTSRVIEAKYLDYCTELTNVKVVPVGTPFQDVMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIRLCRNRNAYK

SEQ ID NO: 3971 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttccgattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtacgccatttcaggatccaatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaaactgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3972 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVPILTSGAALFSYFFNFLKRPGHEFPFPAIRLSKREQVKMREMFEKEPDEEDPLAPGNAGIMLMCTSRVIEAKYLDYCTELTNVKVVPVGTPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 3973 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttccgattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagtcggatgaagaagatccgttagcacctggcaatgccggtatcatgctgatgtgcacgagccgcgtaattgaggctaagtacctggactattgcaccgaactgaccaatgtaaaagttgttccggttggtacgccatttcaggatccaatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaaactgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacatttctagaaacctgagagcgagacgcgaggaggaaatgaatgcagcggcggaagaactgatacggctgtgtcgcaaccgcaacgcctacaag

SEQ ID NO: 3974 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVPILTSGAALFSYFFNFLKRPGHEFPFPAIRLSKREQVKMREMFEKESDEEDPLAPGNAGIMLMCTSRVIEAKYLDYCTELTNVKVVPVGTPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISRNLRARREEEMNAAAEELIRLCRNRNAYK

SEQ ID NO: 3975 - DNA, 1350 bp, Artificial Sequence
  "Variant of ADP-beta-1,2-glycosyltransferase"
atgcaccatcataatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgtcggctcccaactttagcaagatcctgcaaaacctgaagccggacctggtcctttacgattttctgcaaccgtgggcagaacaggtcgtgctagaacaggggatcccggctgttccgattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtacgccatttcaggatccaatgaccgaagatatcgacgacaaagaactgattgattggttagataccaaacccgaaaacagtgttgtctatgtgtcgtttggcagcgaatacttcctgagccgtgaagatatggaagaagttgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacatttctagaaacctgagagcgagacgcgaggaggaaatgaatgcagcggcggaagaactgatacggctgtgtcgcaaccgcaacgcctacaag

SEQ ID NO: 3976 - protein, 450 aa, Artificial Sequence
  "Variant of ADP-beta-1,2-glycosyltransferase"
MHHHNEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVPILTSGAALFSYFFNFLKRPGHEFPFPAIRLSKREQVKMREMFEKEPDEEDPLAPGNAGIMLMCTSRVIEAKYLDYCTELTNVKVVPVGTPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISRNLRARREEEMNAAAEELIRLCRNRNAYK

SEQ ID NO: 3977 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatggcggctcccaactttagcaagatcctgcaaaacctgaagccggacctggtcctttacgattttctgcaaccgtgggcagaacaggtcgtgctagaacaggggatcccggctgttccgattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtacgccatttcaggatgtgatgaccgaagatatcgacgacaaagaactgattgattggttagataccaaacccgaaaacagtgttgtctatgtgtcgtttggcagcgaatacttcctgagccgtgaagatatggaagaagttgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtccttaaagatgtgattaccggccccactggtgagatcctgcgcgcgagagtacgcgacatttctagaaacctgagagcgagacgcgaggaggaaatgaatgcagcggcggaagaactgatacggctgtgtcgcaaccgcaacgcctacaag

SEQ ID NO: 3978 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMAAPNFSKILQNLKPDLVLYDFLQPWAEQVVLEQGIPAVPILTSGAALFSYFFNFLKRPGHEFPFPAIRLSKREQVKMREMFEKEPDEEDPLAPGNAGIMLMCTSRVIEAKYLDYCTELTNVKVVPVGTPFQDVMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRARVRDISRNLRARREEEMNAAAEELIRLCRNRNAYK

SEQ ID NO: 3979 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttccgattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatgtgatgaccgaagatatcgacgacaaagaactgattgattggttagataccaaacccgaaaacagtgttgtctatgtgtcgtttggcagcgaatacttcctgagccgtgaagatatggaagaagttgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3980 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVPILTSGAALFSYFFNFLKRPGHEFPFPAIRLSKREQVKMREMFEKEPDEEDPLAPGNAGIMLMCTSRVIEAKYLDYCTELTNVKVVPVGPPFQDVMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 3981 - DNA, 1347 bp, Artificial Sequence
  "Variant of ADP-beta-1,2-glycosyltransferase"
atgcatcataatgaaggcagcagcggccagaccctgagagtactgatgtttccgtggcttgcgctgggtcatattaacccgtttttgcgtatcgctaaagacctggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatggcggctcccaactttagcaagatcctgcaaaacctgaagccggacctggtcctttacgattttctgcaaccgtgggcagaacaggtcgtgctagaacaggggatcccggctgttccgattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatgtgatgaccgaagatatcgacgacaaagaactgattgattggttagataccaaacccgaaaacagtgttgtctatgtgtcgtttggcagcgaatacttcctgagccgtgaagatatggaagaagttgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtccttaaagatgtgattaccggccccactggtgagatcctgcgcgcgagagtacgcgacatttctagaaacctgagagcgagacgcgaggaggaaatgaatgcagcggcggaagaactgatacagctgtgtcgcaaccgcaacgcctacaag

SEQ ID NO: 3982 - protein, 449 aa, Artificial Sequence
  "Variant of ADP-beta-1,2-glycosyltransferase"
MHHNEGSSGQTLRVLMFPWLALGHINPFLRIAKDLADRGFLIYLCSTLINLESIKKRIPEKYSNSIHLVELPLPELPELPPHYHTTNGLPPHLNGTLHKALKMAAPNFSKILQNLKPDLVLYDFLQPWAEQVVLEQGIPAVPILTSGAALFSYFFNFLKRPGHEFPFPAIRLSKREQVKMREMFEKEPDEEDPLAPGNAGIMLMCTSRVIEAKYLDYCTELTNVKVVPVGPPFQDVMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRARVRDISRNLRARREEEMNAAAEELIQLCRNRNAYK

SEQ ID NO: 3983 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgtcggctcccaactttagcaagatcctgcaaaacctgaagccggacctggtcctttacgattttctgcaaccgtgggcagaacaggtcgtgctagaacaggggatcccggctgttaagattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagtcggatgaagaagatccgttagcacctggcaatgccggtatcatgctgatgtgcacgagccgcgtaattgaggctaagtacctggactattgcaccgaactgaccaatgtaaaagttgttccggttggtacgccatttcaggatccaatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtccttaaagatgtgattaccggccccactggtgagatcctgcgcgcgagagtacgcgacatttctagaaacctgagagcgagacgcgaggaggaaatgaatgcagcggcggaagaactgatacggctgtgtcgcaaccgcaacgcctacaag

SEQ ID NO: 3984 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKESDEEDPLAPGNAGIMLMCTSRVIEAKYLDYCTELTNVKVVPVGTPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRARVRDISRNLRARREEEMNAAAEELIRLCRNRNAYK

SEQ ID NO: 3985 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatggcggctcccaactttagcaagatcctgcaaaacctgaagccggacctggtcctttacgattttctgcaaccgtgggcagaacaggtcgtgctagaacaggggatcccggctgttaagattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatttgatgaccgaagatatcgacgacaaagaactgattgattggttagataccaaacccgaaaacagtgttgtctatgtgtcgtttggcagcgaatacttcctgagccgtgaagatatggaagaagttgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacatttctagaaacctgagagcgagacgcgaggaggaaatgaatgcagcggcggaagaactgatacggctgtgtcgcaaccgcaacgcctacaag

SEQ ID NO: 3986 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMAAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDLMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISRNLRARREEEMNAAAEELIRLCRNRNAYK

SEQ ID NO: 3987 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatggcggctcccaactttagcaagatcctgcaaaacctgaagccggacctggtcctttacgattttctgcaaccgtgggcagaacaggtcgtgctagaacaggggatcccggctgttaagattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccaatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3988 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMAAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKNLRARREEEMNAAAEELIQLCRNRNAYK

SEQ ID NO: 3989 - DNA, 1350 bp, Artificial Sequence
  "Variant of ADP-beta-1,2-glycosyltransferase"
atgcaccatcataatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatggcggctcccaactttagcaagatcctgcaaaacctgaagccggacctggtcctttacgattttctgcaaccgtgggcagaacaggtcgtgctagaacaggggatcccggctgttaagattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatgtgatgaccgaagatatcgacgacaaagaactgattgattggttagataccaaacccgaaaacagtgttgtctatgtgtcgtttggcagcgaatacttcctgagccgtgaagatatggaagaagttgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaaactgatcgtggaattaggcgttgcagtggagatcgtgcgtgatgaagatggccggattcaccgcggcgaaattgcccaagtccttaaagatgtgattaccggccccactggtgagatcctgcgcgcgagagtacgcgacatttctagaaacctgagagcgagacgcgaggaggaaatgaatgcagcggcggaagaactgatacggctgtgtcgcaaccgcaacgcctacaag

SEQ ID NO: 3990 - protein, 450 aa, Artificial Sequence
  "Variant of ADP-beta-1,2-glycosyltransferase"
MHHHNEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMAAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDVMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRARVRDISRNLRARREEEMNAAAEELIRLCRNRNAYK

SEQ ID NO: 3991 - DNA, 1347 bp, Artificial Sequence
  "Variant of ADP-beta-1,2-glycosyltransferase"
atgcatcataatgaaggcagcagcggccagaccctgagagtactgatgtttccgtggcttgcgctgggtcatattaacccgtttttgcgtatcgctaaagacctggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgtcggctcccaactttagcaagatcctgcaaaacctgaagccggacctggtcctttacgattttctgcaaccgtgggcagaacaggtcgtgctagaacaggggatcccggctgttaagattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtacgccatttcaggatccaatgaccgaagatatcgacgacaaagaactgattgattggttagataccaaacccgaaaacagtgttgtctatgtgtcgtttggcagcgaatacttcctgagccgtgaagatatggaagaacttgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtccttaaagatgtgattaccggccccactggtgagatcctgcgcgcgagagtacgcgacatttctaaaaacctgagagcgagacgcgaggaggaaatgaatgcagcggcggaagaactgatacagctgtgtcgcaaccgcaacgcctacaag

SEQ ID NO: 3992 - protein, 449 aa, Artificial Sequence
  "Variant of ADP-beta-1,2-glycosyltransferase"
MHHNEGSSGQTLRVLMFPWLALGHINPFLRIAKDLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGTPFQDPMTEDIDDKELIDWLDTKPENSVVYVSFGSEYFLSREDMEELAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRARVRDISKNLRARREEEMNAAAEELIQLCRNRNAYK

SEQ ID NO: 3993 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatggcggctcccaactttagcaagatcctgcaaaacctgaagccggacctggtcctttacgattttctgcaaccgtgggcagaacaggtcgtgctagaacaggggatcccggctgttaagattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagtcggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatgtgatgaccgaagatatcgacgacaaagaactgattgattggttagataccaaacccgaaaacagtgttgtctatgtgtcgtttggcagcgaatacttcctgagccgtgaagatatggaagaagttgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3994 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMAAPNFSKILQNLKPDLVLYDFLQPWAEQVVLEQGIPAVKILTSGAALFSYFFNFLKRPGHEFPFPAIRLSKREQVKMREMFEKESDEEDPLAPGNAGIMLMCTSRVIEAKYLDYCTELTNVKVVPVGPPFQDVMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 3995 - DNA, 1347 bp, Artificial Sequence
  "Variant of ADP-beta-1,2-glycosyltransferase"
atgcatcataatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatggcggctcccaactttagcaagatcctgcaaaacctgaagccggacctggtcctttacgattttctgcaaccgtgggcagaacaggtcgtgctagaacaggggatcccggctgttccgattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtacgccatttcaggatccaatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtccttaaagatgtgattaccggccccactggtgagatcctgcgcgcgagagtacgcgacatttctagaaacctgagagcgagacgcgaggaggaaatgaatgcagcggcggaagaactgatacagctgtgtcgcaaccgcaacgcctacaag

SEQ ID NO: 3996 - protein, 449 aa, Artificial Sequence
  "Variant of ADP-beta-1,2-glycosyltransferase"
MHHNEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMAAPNFSKILQNLKPDLVLYDFLQPWAEQVVLEQGIPAVPILTSGAALFSYFFNFLKRPGHEFPFPAIRLSKREQVKMREMFEKEPDEEDPLAPGNAGIMLMCTSRVIEAKYLDYCTELTNVKVVPVGTPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRARVRDISRNLRARREEEMNAAAEELIQLCRNRNAYK

SEQ ID NO: 3997 - DNA, 1347 bp, Artificial Sequence
  "Variant of ADP-beta-1,2-glycosyltransferase"
atgcatcataatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaacttgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 3998 - protein, 449 aa, Artificial Sequence
  "Variant of ADP-beta-1,2-glycosyltransferase"
MHHNEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEELAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 3999 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaagattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtacgccatttcaggatttgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4000 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGTPFQDLMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4001 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatttgatgaccgaagatatcgacgacaaagaactgattgattggttagataccaaacccgaaaacagtgttgtctatgtgtcgtttggcagcgaatacttcctgagccgtgaagatatggaagaagttgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacatttctagaaacctgagagcgagacgcgaggaggaaatgaatgcagcggcggaagaactgatacagctgtgtcgcaaccgcaacgcctacaag

SEQ ID NO: 4002 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDLMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISRNLRARREEEMNAAAEELIQLCRNRNAYK

SEQ ID NO: 4003 - DNA, 1350 bp, Artificial Sequence
  "Variant of ADP-beta-1,2-glycosyltransferase"
atgcaccatcataatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgtcggctcccaactttagcaagatcctgcaaaacctgaagccggacctggtcctttacgattttctgcaaccgtgggcagaacaggtcgtgctagaacaggggatcccggctgttccgattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccaatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4004 - protein, 450 aa, Artificial Sequence
  "Variant of ADP-beta-1,2-glycosyltransferase"
MHHHNEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVPILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKNLRARREEEMNAAAEELIQLCRNRNAYK

SEQ ID NO: 4005 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgtcggctcccaactttagcaagatcctgcaaaacctgaagccggacctggtcctttacgattttctgcaaccgtgggcagaacaggtcgtgctagaacaggggatcccggctgttccgattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4006 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVPILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4007 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaagacctggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatggcggctcccaactttagcaagatcctgcaaaacctgaagccggacctggtcctttacgattttctgcaaccgtgggcagaacaggtcgtgctagaacaggggatcccggctgttaagattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagtcggatgaagaagatccgttagcacctggcaatgccggtatcatgctgatgtgcacgagccgcgtaattgaggctaagtacctggactattgcaccgaactgaccaatgtaaaagttgttccggttggtacgccatttcaggatccaatgaccgaagatatcgacgacaaagaactgattgattggttagataccaaacccgaaaacagtgttgtctatgtgtcgtttggcagcgaatacttcctgagccgtgaagatatggaagaagttgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtccttaaagatgtgattaccggccccactggtgagatcctgcgcgcgagagtacgcgacatttctaaaaacctgagagcgagacgcgaggaggaaatgaatgcagcggcggaagaactgatacagctgtgtcgcaaccgcaacgcctacaag

SEQ ID NO: 4008 - protein, 450 aa, Artificial Sequence
  "Variant of ADP-beta-1,2-glycosyltransferase"
MHHHHEGSSGQTLRVLMFPWLALGHINPFLRIAKDLADRGFLIYLCSTLINLESIKKRIPEKYSNSIHLVELPLPELPELPPHYHTTNGLPPHLNGTLHKALKMAAPNFSKILQNLKPDLVLYDFLQPWAEQVVLEQGIPAVKILTSGAALFSYFFNFLKRPGHEFPFPAIRLSKREQVKMREMFEKESDEEDPLAPGNAGIMLMCTSRVIEAKYLDYCTELTNVKVVPVGTPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRARVRDISKNLRARREEEMNAAAEELIQLCRNRNAYK

SEQ ID NO: 4009 - DNA, 1347 bp, Artificial Sequence
  "Variant of ADP-beta-1,2-glycosyltransferase"
atgcatcataatgaaggcagcagcggccagaccctgagagtactgatgtttccgtggcttgcgctgggtcatattaacccgtttttgcgtatcgctaaagacctggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttccgattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtacgccatttcaggatttgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaaactgatcgtggaattaggcgttgcagtggagatcgtgcgtgatgaagatggccggattcaccgcggcgaaattgcccaagtccttaaagatgtgattaccggccccactggtgagatcctgcgcgcgagagtacgcgacatttctagaaacctgagagcgagacgcgaggaggaaatgaatgcagcggcggaagaactgatacggctgtgtcgcaaccgcaacgcctacaag

SEQ ID NO: 4010 - protein, 449 aa, Artificial Sequence
  "Variant of ADP-beta-1,2-glycosyltransferase"
MHHNEGSSGQTLRVLMFPWLALGHINPFLRIAKDLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVPILTSGAALFSYFFNFLKRPGHEFPFPAIRLSKREQVKMREMFEKEPDEEDPLAPGNAGIMLMCTSRVIEAKYLDYCTELTNVKVVPVGTPFQDLMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRARVRDISRNLRARREEEMNAAAEELIRLCRNRNAYK

SEQ ID NO: 4011 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatggcggctcccaactttagcaagatcctgcaaaacctgaagccggacctggtcctttacgattttctgcaaccgtgggcagaacaggtcgtgctagaacaggggatcccggctgttaagattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatttgatgaccgaagatatcgacgacaaagaactgattgattggttagataccaaacccgaaaacagtgttgtctatgtgtcgtttggcagcgaatacttcctgagccgtgaagatatggaagaacttgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtccttaaagatgtgattaccggccccactggtgagatcctgcgcgcgagagtacgcgacatttctagaaacctgagagcgagacgcgaggaggaaatgaatgcagcggcggaagaactgatacagctgtgtcgcaaccgcaacgcctacaag

SEQ ID NO: 4012 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMAAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDLMTEDIDDKELIDWLDTKPENSVVYVSFGSEYFLSREDMEELAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRARVRDISRNLRARREEEMNAAAEELIQLCRNRNAYK

SEQ ID NO: 4013 - DNA, 1350 bp, Artificial Sequence
  "Variant of ADP-beta-1,2-glycosyltransferase"
atgcaccatcataatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatggcggctcccaactttagcaagatcctgcaaaacctgaagccggacctggtcctttacgattttctgcaaccgtgggcagaacaggtcgtgctagaacaggggatcccggctgttaagattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtacgccatttcaggatttgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtccttaaagatgtgattaccggccccactggtgagatcctgcgcgcgagagtacgcgacatttctaaaaacctgagagcgagacgcgaggaggaaatgaatgcagcggcggaagaactgatacggctgtgtcgcaaccgcaacgcctacaag

SEQ ID NO: 4014 - protein, 450 aa, Artificial Sequence
  "Variant of ADP-beta-1,2-glycosyltransferase"
MHHHNEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMAAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGTPFQDLMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRARVRDISKNLRARREEEMNAAAEELIRLCRNRNAYK

SEQ ID NO: 4015 - DNA, 1350 bp, Artificial Sequence
  "Variant of ADP-beta-1,2-glycosyltransferase"
atgcaccatcataatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgtcggctcccaactttagcaagatcctgcaaaacctgaagccggacctggtcctttacgattttctgcaaccgtgggcagaacaggtcgtgctagaacaggggatcccggctgttccgattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtacgccatttcaggatttgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgagagtacgcgacatttctagaaacctgagagcgagacgcgaggaggaaatgaatgcagcggcggaagaactgatacagctgtgtcgcaaccgcaacgcctacaag

SEQ ID NO: 4016 - protein, 450 aa, Artificial Sequence
  "Variant of ADP-beta-1,2-glycosyltransferase"
MHHHNEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVPILTSGAALFSYFFNFLKRPGHEFPFPAIRLSKREQVKMREMFEKEPDEEDPLAPGNAGIMLMCTSRVIEAKYLDYCTELTNVKVVPVGTPFQDLMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRARVRDISRNLRARREEEMNAAAEELIQLCRNRNAYK

SEQ ID NO: 4017 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatggcggctcccaactttagcaagatcctgcaaaacctgaagccggacctggtcctttacgattttctgcaaccgtgggcagaacaggtcgtgctagaacaggggatcccggctgttccgattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaacttgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4018 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMAAPNFSKILQNLKPDLVLYDFLQPWAEQVVLEQGIPAVPILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEELAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKNLRARREEEMNAAAEELIQLCRNRNAYK

SEQ ID NO: 4019 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttccgattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatttgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaaactgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacatttctagaaacctgagagcgagacgcgaggaggaaatgaatgcagcggcggaagaactgatacggctgtgtcgcaaccgcaacgcctacaag

SEQ ID NO: 4020 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVPILTSGAALFSYFFNFLKRPGHEFPFPAIRLSKREQVKMREMFEKEPDEEDPLAPGNAGIMLMCTSRVIEAKYLDYCTELTNVKVVPVGPPFQDLMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISRNLRARREEEMNAAAEELIRLCRNRNAYK

SEQ ID NO: 4021 - DNA, 1350 bp, Artificial Sequence
  "Variant of ADP-beta-1,2-glycosyltransferase"
atgcaccatcataatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgtcggctcccaactttagcaagatcctgcaaaacctgaagccggacctggtcctttacgattttctgcaaccgtgggcagaacaggtcgtgctagaacaggggatcccggctgttaagattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtacgccatttcaggatccaatgaccgaagatatcgacgacaaagaactgattgattggttagataccaaacccgaaaacagtgttgtctatgtgtcgtttggcagcgaatacttcctgagccgtgaagatatggaagaagttgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgagagtacgcgacatttctagaaacctgagagcgagacgcgaggaggaaatgaatgcagcggcggaagaactgatacagctgtgtcgcaaccgcaacgcctacaag

SEQ ID NO: 4022 - protein, 450 aa, Artificial Sequence
  "Variant of ADP-beta-1,2-glycosyltransferase"
MHHHNEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGTPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRARVRDISRNLRARREEEMNAAAEELIQLCRNRNAYK

SEQ ID NO: 4023 - DNA, 1350 bp, Artificial Sequence
  "Variant of ADP-beta-1,2-glycosyltransferase"
atgcaccatcataatgaaggcagcagcggccagaccctgagagtactgatgtttccgtggcttgcgctgggtcatattaacccgtttttgcgtatcgctaaagacctggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaagattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtacgccatttcaggatccaatgaccgaagatatcgacgacaaagaactgattgattggttagataccaaacccgaaaacagtgttgtctatgtgtcgtttggcagcgaatacttcctgagccgtgaagatatggaagaagttgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtccttaaagatgtgattaccggccccactggtgagatcctgcgcgcgagagtacgcgacatttctagaaacctgagagcgagacgcgaggaggaaatgaatgcagcggcggaagaactgatacagctgtgtcgcaaccgcaacgcctacaag

SEQ ID NO: 4024 - protein, 450 aa, Artificial Sequence
  "Variant of ADP-beta-1,2-glycosyltransferase"
MHHHNEGSSGQTLRVLMFPWLALGHINPFLRIAKDLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGTPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRARVRDISRNLRARREEEMNAAAEELIQLCRNRNAYK

SEQ ID NO: 4025 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgtcggctcccaactttagcaagatcctgcaaaacctgaagccggacctggtcctttacgattttctgcaaccgtgggcagaacaggtcgtgctagaacaggggatcccggctgttaagattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagtcggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatttgatgaccgaagatatcgacgacaaagaactgattgattggttagataccaaacccgaaaacagtgttgtctatgtgtcgtttggcagcgaatacttcctgagccgtgaagatatggaagaaattgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaaactgatcgtggaattaggcgttgcagtggagatcgtgcgtgatgaagatggccggattcaccgcggcgaaattgcccaagtccttaaagatgtgattaccggccccactggtgagatcctgcgcgcgagagtacgcgacatttctaaaaacctgagagcgagacgcgaggaggaaatgaatgcagcggcggaagaactgatacggctgtgtcgcaaccgcaacgcctacaag

SEQ ID NO: 4026 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKESDEEDPLAPGNAGIMLMCTSRVIEAKYLDYCTELTNVKVVPVGPPFQDLMTEDIDDKELIDWLDTKPENSVVYVSFGSEYFLSREDMEEIAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRARVRDISKNLRARREEEMNAAAEELIRLCRNRNAYK

SEQ ID NO: 4027 - DNA, 1350 bp, Artificial Sequence
  "Variant of ADP-beta-1,2-glycosyltransferase"
atgcaccatcataatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgtcggctcccaactttagcaagatcctgcaaaacctgaagccggacctggtcctttacgattttctgcaaccgtgggcagaacaggtcgtgctagaacaggggatcccggctgttccgattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatttgatgaccgaagatatcgacgacaaagaactgattgattggttagataccaaacccgaaaacagtgttgtctatgtgtcgtttggcagcgaatacttcctgagccgtgaagatatggaagaacttgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtccttaaagatgtgattaccggccccactggtgagatcctgcgcgcgagagtacgcgacatttctagaaacctgagagcgagacgcgaggaggaaatgaatgcagcggcggaagaactgatacagctgtgtcgcaaccgcaacgcctacaag

SEQ ID NO: 4028 - protein, 450 aa, Artificial Sequence
  "Variant of ADP-beta-1,2-glycosyltransferase"
MHHHNEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVPILTSGAALFSYFFNFLKRPGHEFPFPAIRLSKREQVKMREMFEKEPDEEDPLAPGNAGIMLMCTSRVIEAKYLDYCTELTNVKVVPVGPPFQDLMTEDIDDKELIDWLDTKPENSVVYVSFGSEYFLSREDMEELAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRARVRDISRNLRARREEEMNAAAEELIQLCRNRNAYK

SEQ ID NO: 4029 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgtcggctcccaactttagcaagatcctgcaaaacctgaagccggacctggtcctttacgattttctgcaaccgtgggcagaacaggtcgtgctagaacaggggatcccggctgttccgattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagtcggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatttgatgaccgaagatatcgacgacaaagaactgattgattggttagataccaaacccgaaaacagtgttgtctatgtgtcgtttggcagcgaatacttcctgagccgtgaagatatggaagaagttgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtccttaaagatgtgattaccggccccactggtgagatcctgcgcgcgagagtacgcgacatttctagaaacctgagagcgagacgcgaggaggaaatgaatgcagcggcggaagaactgatacagctgtgtcgcaaccgcaacgcctacaag

SEQ ID NO: 4030 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVPILTSGAALFSYFFNFLKRPGHEFPFPAIRLSKREQVKMREMFEKESDEEDPLAPGNAGIMLMCTSRVIEAKYLDYCTELTNVKVVPVGPPFQDLMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRARVRDISRNLRARREEEMNAAAEELIQLCRNRNAYK

SEQ ID NO: 4031 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttccgattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagtcggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaaactgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4032 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVPILTSGAALFSYFFNFLKRPGHEFPFPAIRLSKREQVKMREMFEKESDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4033 - DNA, 1350 bp, Artificial Sequence
  "Variant of ADP-beta-1,2-glycosyltransferase"
atgcaccatcataatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatggcggctcccaactttagcaagatcctgcaaaacctgaagccggacctggtcctttacgattttctgcaaccgtgggcagaacaggtcgtgctagaacaggggatcccggctgttaagattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatttgatgaccgaagatatcgacgacaaagaactgattgattggttagataccaaacccgaaaacagtgttgtctatgtgtcgtttggcagcgaatacttcctgagccgtgaagatatggaagaaattgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaaactgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacatttctagaaacctgagagcgagacgcgaggaggaaatgaatgcagcggcggaagaactgatacggctgtgtcgcaaccgcaacgcctacaag

SEQ ID NO: 4034 - protein, 450 aa, Artificial Sequence
  "Variant of ADP-beta-1,2-glycosyltransferase"
MHHHNEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMAAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDLMTEDIDDKELIDWLDTKPENSVVYVSFGSEYFLSREDMEEIAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISRNLRARREEEMNAAAEELIRLCRNRNAYK

SEQ ID NO: 4035 - DNA, 1350 bp, Artificial Sequence
  "Variant of ADP-beta-1,2-glycosyltransferase"
atgcaccatcataatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaagattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagttgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtccttaaagatgtgattaccggccccactggtgagatcctgcgcgcgagagtacgcgacatttctaaaaacctgagagcgagacgcgaggaggaaatgaatgcagcggcggaagaactgatacagctgtgtcgcaaccgcaacgcctacaag

SEQ ID NO: 4036 - protein, 450 aa, Artificial Sequence
  "Variant of ADP-beta-1,2-glycosyltransferase"
MHHHNEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRARVRDISKNLRARREEEMNAAAEELIQLCRNRNAYK

SEQ ID NO: 4037 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaagattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatgtgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacggctgtgtcgcaaccgcaacgcctacaag

SEQ ID NO: 4038 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDVMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKNLRARREEEMNAAAEELIRLCRNRNAYK

SEQ ID NO: 4039 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaagacctggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaagattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4040 - protein, 450 aa, Artificial Sequence
  "Variant of ADP-beta-1,2-glycosyltransferase"
MHHHHEGSSGQTLRVLMFPWLALGHINPFLRIAKDLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4041 - DNA, 1347 bp, Artificial Sequence
  "Variant of ADP-beta-1,2-glycosyltransferase"
atgcatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatggcggctcccaactttagcaagatcctgcaaaacctgaagccggacctggtcctttacgattttctgcaaccgtgggcagaacaggtcgtgctagaacaggggatcccggctgttccgattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtacgccatttcaggatttgatgaccgaagatatcgacgacaaagaactgattgattggttagataccaaacccgaaaacagtgttgtctatgtgtcgtttggcagcgaatacttcctgagccgtgaagatatggaagaacttgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacggctgtgtcgcaaccgcaacgcctacaag

SEQ ID NO: 4042 - protein, 449 aa, Artificial Sequence
  "Variant of ADP-beta-1,2-glycosyltransferase"
MHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMAAPNFSKILQNLKPDLVLYDFLQPWAEQVVLEQGIPAVPILTSGAALFSYFFNFLKRPGHEFPFPAIRLSKREQVKMREMFEKEPDEEDPLAPGNAGIMLMCTSRVIEAKYLDYCTELTNVKVVPVGTPFQDLMTEDIDDKELIDWLDTKPENSVVYVSFGSEYFLSREDMEELAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKNLRARREEEMNAAAEELIRLCRNRNAYK

SEQ ID NO: 4043 - DNA, 1350 bp, Artificial Sequence
  "Variant of ADP-beta-1,2-glycosyltransferase"
atgcaccatcataatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgtcggctcccaactttagcaagatcctgcaaaacctgaagccggacctggtcctttacgattttctgcaaccgtgggcagaacaggtcgtgctagaacaggggatcccggctgttaagattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagtcggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatgtgatgaccgaagatatcgacgacaaagaactgattgattggttagataccaaacccgaaaacagtgttgtctatgtgtcgtttggcagcgaatacttcctgagccgtgaagatatggaagaaattgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtccttaaagatgtgattaccggccccactggtgagatcctgcgcgcgagagtacgcgacatttctagaaacctgagagcgagacgcgaggaggaaatgaatgcagcggcggaagaactgatacggctgtgtcgcaaccgcaacgcctacaag

SEQ ID NO: 4044 - protein, 450 aa, Artificial Sequence
  "Variant of ADP-beta-1,2-glycosyltransferase"
MHHHNEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKESDEEDPLAPGNAGIMLMCTSRVIEAKYLDYCTELTNVKVVPVGPPFQDVMTEDIDDKELIDWLDTKPENSVVYVSFGSEYFLSREDMEEIAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRARVRDISRNLRARREEEMNAAAEELIRLCRNRNAYK

SEQ ID NO: 4045 - DNA, 1350 bp, Artificial Sequence
  "Variant of ADP-beta-1,2-glycosyltransferase"
atgcaccatcataatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgtcggctcccaactttagcaagatcctgcaaaacctgaagccggacctggtcctttacgattttctgcaaccgtgggcagaacaggtcgtgctagaacaggggatcccggctgttccgattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtacgccatttcaggatttgatgaccgaagatatcgacgacaaagaactgattgattggttagataccaaacccgaaaacagtgttgtctatgtgtcgtttggcagcgaatacttcctgagccgtgaagatatggaagaacttgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaaactgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacatttctaaaaacctgagagcgagacgcgaggaggaaatgaatgcagcggcggaagaactgatacagctgtgtcgcaaccgcaacgcctacaag

SEQ ID NO: 4046 - protein, 450 aa, Artificial Sequence
  "Variant of ADP-beta-1,2-glycosyltransferase"
MHHHNEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVPILTSGAALFSYFFNFLKRPGHEFPFPAIRLSKREQVKMREMFEKEPDEEDPLAPGNAGIMLMCTSRVIEAKYLDYCTELTNVKVVPVGTPFQDLMTEDIDDKELIDWLDTKPENSVVYVSFGSEYFLSREDMEELAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4047 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaagattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatgtgatgaccgaagatatcgacgacaaagaactgattgattggttagataccaaacccgaaaacagtgttgtctatgtgtcgtttggcagcgaatacttcctgagccgtgaagatatggaagaagttgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4048 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDVMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKNLRARREEEMNAAAEELIQLCRNRNAYK

SEQ ID NO: 4049 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagactgagacgcgaggaggaaatgaatgcagcggcggaagaactgatacagctgtgtcgcaaccgcaacgcctacaag

SEQ ID NO: 4050 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRLRREEEMNAAAEELIQLCRNRNAYK

SEQ ID NO: 4051 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaagctattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4052 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMEAIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4053 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgtttgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4054 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMFEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4055 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcaggaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4056 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKQEQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4057 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttagggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4058 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFRDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4059 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaactggctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4060 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNWLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4061 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcctgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4062 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQACILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4063 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgtatgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4064 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMYEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4065 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatctatgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4066 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIYDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4067 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgcctgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4068 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMPEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4069 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgaggagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4070 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGEEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4071 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattcattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4072 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIHWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4073 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcagggacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4074 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIRDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4075 - DNA, 1350 bp, Artificial Sequence
  "Variant of ADP-beta-1,2-glycosyltransferase"
atgcacaatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4076 - protein, 450 aa, Artificial Sequence
  "Variant of ADP-beta-1,2-glycosyltransferase"
MHNHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4077 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgtcgcgcgaggaggaaatgaatgcagcggcggaagaactgatacagctgtgtcgcaaccgcaacgcctacaag

SEQ ID NO: 4078 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRASREEEMNAAAEELIQLCRNRNAYK

SEQ ID NO: 4079 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggttttgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4080 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGFEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4081 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgcctaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4082 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLPNLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4083 - DNA, 1350 bp, Artificial Sequence
  "Variant of ADP-beta-1,2-glycosyltransferase"
atgcaccatcatcatgaaggccggagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4084 - protein, 450 aa, Artificial Sequence
  "Variant of ADP-beta-1,2-glycosyltransferase"
MHHHHEGRSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4085 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgggtgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4086 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMGEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4087 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgatggaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4088 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMMEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4089 - DNA, 1350 bp, Artificial Sequence
  "Variant of ADP-beta-1,2-glycosyltransferase"
atgcaccatcatcatgaaggcgttagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4090 - protein, 450 aa, Artificial Sequence
  "Variant of ADP-beta-1,2-glycosyltransferase"
MHHHHEGVSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4091 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattggttggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4092 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIGWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4093 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcggtgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4094 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIGDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4095 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatgcgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4096 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDAMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4097 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatccatgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4098 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIHDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4099 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcagtgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4100 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDISDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4101 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtttggagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4102 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGLEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4103 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatttgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4104 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDLMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4105 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaatttccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4106 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEFPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4107 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcctgaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4108 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKPEQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4109 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctggtgaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4110 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLVNLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4111 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagacggaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4112 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKTEQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4113 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgctgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4114 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGAEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4115 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaagctgctgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4116 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKLLKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4117 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgactgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4118 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELTDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4119 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactggcgaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4120 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELANVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4121 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgctgaatgtaaaagttgttccggttggtccgccatttcaggatccgatgaccgaagatatcggcgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4122 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELLNVKVVPVGPPFQDPMTEDIGDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4123 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacgtgggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4124 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLERGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4125 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgacgcgcgaggaggaaatgaatgcagcggcggaagaactgatacagctgtgtcgcaaccgcaacgcctacaag

SEQ ID NO: 4126 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRATREEEMNAAAEELIQLCRNRNAYK

SEQ ID NO: 4127 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccgtataaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4128 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPYKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4129 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgttgatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4130 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTVDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4131 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccgaataaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4132 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPNKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4133 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgcagcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4134 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPQQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4135 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaagcgaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4136 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEANLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4137 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggaggcgtacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4138 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEAYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4139 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagctaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4140 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKLPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4141 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctgacgcatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4142 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLTHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4143 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacaataaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4144 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDNKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4145 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgcaggaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4146 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELPLPELPELPPHYHTTNGLPPHLNGTLHKALKMSAPNFSKILQNLKPDLVLYDFLQPWAEQVVLEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMQEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4147 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtacctcgattaacctcgaaagcatcaaaaagagaatcccggagaaatacagtaatagcatccatctggttgagctgcctctgccagaattaccggaactgccaccacattaccatactaccaacggtttaccaccgcatctgaacggtaccctgcacaaggcactgaagatgagcgctcccaactttagcaagatcctgcaaaacctgaagccggacctggtcctttacgattttctgcagccgtgggcagaacaggtcgccctagaacaggggatcccggctgttaaaattctaaccagtggtgcggcactgtttgcgtacatgttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattactggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4148 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTSINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFAYMFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4149 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgcgattaacctcgaaagcatcaaaaagagaatcccggagaaatacagtaatagcatccatctggttgagctgcctctgccagaattaccggaactgccaccacattaccatactaccaacggtttaccaccgcatctgaacggtaccctgcacaaggcactgaagatgagcgctcccaactttagcaagatcctgcaaaacctgaagccggacctggtcctttacgattttctgcagccgtgggcagaacaggtcgccctagaacaggggatcccggctgttaaaattctaaccagtggtgcggcactgtttgcgtactttttcaacttcctgaagcgaccgggtcacgagtttccgtttccggcaatccgcctgtcgaagcgagaacaggtgaagatgcgcgagatgtttgaaaaggagccggatgaagaagatccgttagcgcctggcagcgcgggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattcagggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4150 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFAYFFNFLKRPGHEFPFPAIRLSKREQVKMREMFEKEPDEEDPLAPGSAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVIQGPTGEILRAKVRDISKNLRARREEEMNAAAEELIQLCRNRNAYK

SEQ ID NO: 4151 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgcgattaacctcgaaagcatcaaaaagagaatcccggagaaatacagtaatagcatccatctggttgagctgcctctgccagaattaccggaactgccaccacattaccatactaccaacggtttaccaccgcatctgaacgctaccctgcacaaggcactgaagatgagcgctcccaactttagcaagatcctgcaaaacctgaagccggacctggtcctttacgattttctgcagccgtgggcagaacaggtcgccctagaacaggggatcccggctgttaaaattctaaccagtggtgcggcactgtttgcgtacatgtggaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattactggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4152 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNATLHKALKMSAPNFSKILQNLKPDLVLYDFLQPWAEQVALEQGIPAVKILTSGAALFAYMWNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4153 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgcgattaacctcgaaagcatcaaaaagagaatcccggagaaatacagtaatagcatccatctggttgagctgcctctgccagaattaccggaactgccaccacattaccatactaccaacggtttaccaccgcatctgaacccgaccctgcacaaggcactgaagatgagcgctcccaactttagcaagatcctgcaaaacctgaagccggacctggtcctttacgattttctgataccgtgggcagaacaggtcgccctagaacaggggatcccggctgttaaaattctaaccagtggtgcggcactgtttgcgtacatgttcaacttcctgaagcgaccgggtcacgagtttccgtttccggcaatccgcctgtcgaagcgagaacaggtgaagatgcgcgagatgtttgaaaaggagccggatgaagaagatccgttagcgcctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattactggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4154 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNPTLHKALKMSAPNFSKILQNLKPDLVLYDFLIPWAEQVALEQGIPAVKILTSGAALFAYMFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4155 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtacctcgattaacctcgaaagcatcaaaaagagaatcccggagaaatacagtaatagcatccatctggttgagctgcctctgccagaattaccggaactgccaccacattaccatactaccaacggtttaccaccgcatctgaacccgaccctgcacaaggcactgaagatgagcgctcccaactttagcaagatcctgcaaaacctgaagccggacctggtcctttacgattttctgcagccgtgggcagaaaaggtcgccctagaacaggggatcccggctgttaaaattctaaccagtggtgcggcactgttttcgtacatgttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatctgatgaccgaagatatcgacgacaaagaactgattgattggttagataccaaacccgaaaacagtgttgtctatgtgtcgtttggcagcgaatacttcctgagccgtgaagatatggaagaactggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattactggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4156 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTSINLESIKKRIPEKYSNSIHLVELPLPELPELPPHYHTTNGLPPHLNPTLHKALKMSAPNFSKILQNLKPDLVLYDFLQPWAEKVALEQGIPAVKILTSGAALFSYMFNFLKRPGHEFPFPAIRLSKREQVKMREMFEKEPDEEDPLAPGNAGIMLMCTSRVIEAKYLDYCTELTNVKVVPVGPPFQDLMTEDIDDKELIDWLDTKPENSVVYVSFGSEYFLSREDMEELAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4157 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgcgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcagccgtgggcagaacatgtcgccctagaacaggggatcccggctgttaaaattctaaccagtggtgcggcactgttttcgtacatgttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4158 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEHVALEQGIPAVKILTSGAALFSYMFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4159 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtacctcgattaacctcgaaagcatcaaaaagagaatcccggagaaatacagtaatagcatccatctggttgagctgcctctgccagaattaccggaactgccaccacattaccatactaccaacggtttaccaccgcatctgaacccgaccctgcacaaggcactgaagatgagcgctcccaactttagcaagatcctgcaaaacctgaagccggacctggtcctttacgattttctgcagccgtgggcagaacaggtcgccctagaacaggggatcccggctgttaaaattctaaccagtggtgcggcactgttttcgtacatgttcaacttcctgaagcgaccgggtcacgagtttccgtttccggcaatccgcctgtcgaagcgagaacaggtgaagatgcgcgagatgtttgaaaaggagccggatgaagaagatccgttagcgcctggcagctcgggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattcagggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4160 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTSINLESIKKRIPEKYSNSIHLVELPLPELPELPPHYHTTNGLPPHLNPTLHKALKMSAPNFSKILQNLKPDLVLYDFLQPWAEQVALEQGIPAVKILTSGAALFSYMFNFLKRPGHEFPFPAIRLSKREQVKMREMFEKEPDEEDPLAPGSSGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVIQGPTGEILRAKVRDISKNLRARREEEMNAAAEELIQLCRNRNAYK

SEQ ID NO: 4161 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacccgaccctgcacaaggcactgaagatgagcgctcccaactttagcaagatcctgcaaaacctgaagccggacctggtcctttacgattttctgataccgtgggcagaacatgtcgccctagaacaggggatcccggctgttaaaattctaaccagtggtgcggcactgtttgcgtactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaactggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattactggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4162 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNPTLHKALKMSAPNFSKILQNLKPDLVLYDFLIPWAEHVALEQGIPAVKILTSGAALFAYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEELAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4163 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgcgattaacctcgaaagcatcaaaaagagaatcccggagaaatacagtaatagcatccatctggttgagctgcctctgccagaattaccggaactgccaccacattaccatactaccaacggtttaccaccgcatctgaacccgaccctgcacaaggcactgaagatgagcgctcccaactttagcaagatcctgcaaaacctgaagccggacctggtcctttacgattttctgcagccgtgggcagaacaggtcgccctagaacaggggatcccggctgttaaaattctaaccagtggtgcggcactgtttgcgtacatgttcaacttcctgaagcgaccgggtcacgagtttccgtttccggcaatccgcctgtcgaagcgagaacaggtgaagatgcgcgagatgtttgaaaaggagccggatgaagaagatccgttagcgcctggcagctcgggtatcatgctgatgtgcacgagccgcgtaattgaggctaagtacctggactattgcaccgaactgaccaatgtaaaagttgttccggttggtccgccatttcaggatctgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattactggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4164 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNPTLHKALKMSAPNFSKILQNLKPDLVLYDFLQPWAEQVALEQGIPAVKILTSGAALFAYMFNFLKRPGHEFPFPAIRLSKREQVKMREMFEKEPDEEDPLAPGSSGIMLMCTSRVIEAKYLDYCTELTNVKVVPVGPPFQDLMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4165 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgcgattaacctcgaaagcatcaaaaagagaatcccggagaaatacagtaatagcatccatctggttgagctgcctctgccagaattaccggaactgccaccacattaccatactaccaacggtttaccaccgcatctgaacggtaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttgcgtacatgttcaacttcctgaagcgaccgggtcacgagtttccgtttccggcaatccgcctgtcgaagcgagaacaggtgaagatgcgcgagatgtttgaaaaggagccggatgaagaagatccgttatcgcctggcagcgcgggtatcatgctgatgtgcacgagccgcgtaattgaggctaagtacctggactattgcaccgaactgaccaatgtaaaagttgttccggttggtccgccatttcaggatctgatgaccgaagatatcgacgacaaagaactgattgattggttagataccaaacccgaaaacagtgttgtctatgtgtcgtttggcagcgaatacttcctgagccgtgaagatatggaagaagtggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattactggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4166 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFAYMFNFLKRPGHEFPFPAIRLSKREQVKMREMFEKEPDEEDPLSPGSAGIMLMCTSRVIEAKYLDYCTELTNVKVVPVGPPFQDLMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4167 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgcgattaacctcgaaagcatcaaaaagagaatcccggagaaatacagtaatagcatccatctggttgagctgcctctgccagaattaccggaactgccaccacattaccatactaccaacggtttaccaccgcatctgaacggtaccctgcacaaggcactgaagatgagcgctcccaactttagcaagatcctgcaaaacctgaagccggacctggtcctttacgattttctgataccgtgggcagaacatgtcgccctagaacaggggatcccggctgttaaaattctaaccagtggtgcggcactgttttcgtacatgtggaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattcagggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4168 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLIPWAEHVALEQGIPAVKILTSGAALFSYMWNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVIQGPTGEILRAKVRDISKNLRARREEEMNAAAEELIQLCRNRNAYK

SEQ ID NO: 4169 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgctaccctgcacaaggcactgaagatgagcgctcccaactttagcaagatcctgcaaaacctgaagccggacctggtcctttacgattttctgcagccgtgggcagaaaaggtcgccctagaacaggggatcccggctgttaaaattctaaccagtggtgcggcactgtttgcgtacatgtggaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattactggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4170 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNATLHKALKMSAPNFSKILQNLKPDLVLYDFLQPWAEKVALEQGIPAVKILTSGAALFAYMWNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4171 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgctaccctgcacaaggcactgaagatgagcgctcccaactttagcaagatcctgcaaaacctgaagccggacctggtcctttacgattttctgcagccgtgggcagaaaaggtcgccctagaacaggggatcccggctgttaaaattctaaccagtggtgcggcactgtttgcgtacatgtggaacttcctgaagcgaccgggtcacgagtttccgtttccggcaatccgcctgtcgaagcgagaacaggtgaagatgcgcgagatgtttgaaaaggagccggatgaagaagatccgttagcgcctggcaactcgggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4172 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNATLHKALKMSAPNFSKILQNLKPDLVLYDFLQPWAEKVALEQGIPAVKILTSGAALFAYMWNFLKRPGHEFPFPAIRLSKREQVKMREMFEKEPDEEDPLAPGNSGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4173 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgcgattaacctcgaaagcatcaaaaagagaatcccggagaaatacagtaatagcatccatctggttgagctgcctctgccagaattaccggaactgccaccacattaccatactaccaacggtttaccaccgcatctgaacccgaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttgcgtactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattcagggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4174 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNPTLHKALKMSAPNFSKILQNLKPDLVLYDFLQPWAEQVALEQGIPAVKILTSGAALFAYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVIQGPTGEILRAKVRDISKNLRARREEEMNAAAEELIQLCRNRNAYK

SEQ ID NO: 4175 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgataccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattcagggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4176 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLIPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVIQGPTGEILRAKVRDISKNLRARREEEMNAAAEELIQLCRNRNAYK

SEQ ID NO: 4177 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgcgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcagccgtgggcagaaaaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatctgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4178 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEKVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDLMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4179 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtacctcgattaacctcgaaagcatcaaaaagagaatcccggagaaatacagtaatagcatccatctggttgagctgcctctgccagaattaccggaactgccaccacattaccatactaccaacggtttaccaccgcatctgaacgctaccctgcacaaggcactgaagatgagcgctcccaactttagcaagatcctgcaaaacctgaagccggacctggtcctttacgattttctgataccgtgggcagaaaaggtcgccctagaacaggggatcccggctgttaaaattctaaccagtggtgcggcactgttttcgtacttttggaacttcctgaagcgaccgggtcacgagtttccgtttccggcaatccgcctgtcgaagcgagaacaggtgaagatgcgcgagatgtttgaaaaggagccggatgaagaagatccgttatcgcctggcaacgcgggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattactggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4180 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTSINLESIKKRIPEKYSNSIHLVELPLPELPELPPHYHTTNGLPPHLNATLHKALKMSAPNFSKILQNLKPDLVLYDFLIPWAEKVALEQGIPAVKILTSGAALFSYFWNFLKRPGHEFPFPAIRLSKREQVKMREMFEKEPDEEDPLSPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4181 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtacctcgattaacctcgaaagcatcaaaaagagaatcccggagaaatacagtaatagcatccatctggttgagctgcctctgccagaattaccggaactgccaccacattaccatactaccaacggtttaccaccgcatctgaacccgaccctgcacaaggcactgaagatgagcgctcccaactttagcaagatcctgcaaaacctgaagccggacctggtcctttacgattttctgataccgtgggcagaacaggtcgccctagaacaggggatcccggctgttaaaattctaaccagtggtgcggcactgtttgcgtactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaactggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattactggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4182 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTSINLESIKKRIPEKYSNSIHLVELPLPELPELPPHYHTTNGLPPHLNPTLHKALKMSAPNFSKILQNLKPDLVLYDFLIPWAEQVALEQGIPAVKILTSGAALFAYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEELAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4183 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgcgattaacctcgaaagcatcaaaaagagaatcccggagaaatacagtaatagcatccatctggttgagctgcctctgccagaattaccggaactgccaccacattaccatactaccaacggtttaccaccgcatctgaacggtaccctgcacaaggcactgaagatgagcgctcccaactttagcaagatcctgcaaaacctgaagccggacctggtcctttacgattttctgataccgtgggcagaacaggtcgccctagaacaggggatcccggctgttaaaattctaaccagtggtgcggcactgtttgcgtacatgttcaacttcctgaagcgaccgggtcacgagtttccgtttccggcaatccgcctgtcgaagcgagaacaggtgaagatgcgcgagatgtttgaaaaggagccggatgaagaagatccgttagcgcctggcagctcgggtatcatgctgatgtgcacgagccgcgtaattgaggctaagtacctggactattgcaccgaactgaccaatgtaaaagttgttccggttggtccgccatttcaggatctgatgaccgaagatatcgacgacaaagaactgattgattggttagataccaaacccgaaaacagtgttgtctatgtgtcgtttggcagcgaatacttcctgagccgtgaagatatggaagaagtggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattactggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4184 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLIPWAEQVALEQGIPAVKILTSGAALFAYMFNFLKRPGHEFPFPAIRLSKREQVKMREMFEKEPDEEDPLAPGSSGIMLMCTSRVIEAKYLDYCTELTNVKVVPVGPPFQDLMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4185 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacggtaccctgcacaaggcactgaagatgagcgctcccaactttagcaagatcctgcaaaacctgaagccggacctggtcctttacgattttctgataccgtgggcagaacatgtcgccctagaacaggggatcccggctgttaaaattctaaccagtggtgcggcactgtttgcgtacttttggaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattactggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4186 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLIPWAEHVALEQGIPAVKILTSGAALFAYFWNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4187 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgcgattaacctcgaaagcatcaaaaagagaatcccggagaaatacagtaatagcatccatctggttgagctgcctctgccagaattaccggaactgccaccacattaccatactaccaacggtttaccaccgcatctgaacggtaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttgcgtactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatctgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4188 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFAYFFNFLKRPGHEFPFPAIRLSKREQVKMREMFEKEPDEEDPLAPGNAGIMLMCTSRVIEAKYLDYCTELTNVKVVPVGPPFQDLMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4189 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgcgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaaaaggtcgccctagaacaggggatcccggctgttaaaattctaaccagtggtgcggcactgtttgcgtacatgttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattactggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4190 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEKVALEQGIPAVKILTSGAALFAYMFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4191 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtacctcgattaacctcgaaagcatcaaaaagagaatcccggagaaatacagtaatagcatccatctggttgagctgcctctgccagaattaccggaactgccaccacattaccatactaccaacggtttaccaccgcatctgaacccgaccctgcacaaggcactgaagatgagcgctcccaactttagcaagatcctgcaaaacctgaagccggacctggtcctttacgattttctgcagccgtgggcagaacatgtcgccctagaacaggggatcccggctgttaaaattctaaccagtggtgcggcactgttttcgtacatgttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattactggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4192 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTSINLESIKKRIPEKYSNSIHLVELPLPELPELPPHYHTTNGLPPHLNPTLHKALKMSAPNFSKILQNLKPDLVLYDFLQPWAEHVALEQGIPAVKILTSGAALFSYMFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4193 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacggtaccctgcacaaggcactgaagatgagcgctcccaactttagcaagatcctgcaaaacctgaagccggacctggtcctttacgattttctgcagccgtgggcagaacaggtcgccctagaacaggggatcccggctgttaaaattctaaccagtggtgcggcactgtttgcgtacatgtggaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatctgatgaccgaagatatcgacgacaaagaactgattgattggttagataccaaacccgaaaacagtgttgtctatgtgtcgtttggcagcgaatacttcctgagccgtgaagatatggaagaagtggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattactggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4194 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFAYMWNFLKRPGHEFPFPAIRLSKREQVKMREMFEKEPDEEDPLAPGNAGIMLMCTSRVIEAKYLDYCTELTNVKVVPVGPPFQDLMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4195 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgcgattaacctcgaaagcatcaaaaagagaatcccggagaaatacagtaatagcatccatctggttgagctgcctctgccagaattaccggaactgccaccacattaccatactaccaacggtttaccaccgcatctgaacgctaccctgcacaaggcactgaagatgagcgctcccaactttagcaagatcctgcaaaacctgaagccggacctggtcctttacgattttctgcagccgtgggcagaacatgtcgccctagaacaggggatcccggctgttaaaattctaaccagtggtgcggcactgtttgcgtacttttggaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattactggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4196 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNATLHKALKMSAPNFSKILQNLKPDLVLYDFLQPWAEHVALEQGIPAVKILTSGAALFAYFWNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4197 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacccgaccctgcacaaggcactgaagatgagcgctcccaactttagcaagatcctgcaaaacctgaagccggacctggtcctttacgattttctgcagccgtgggcagaacatgtcgccctagaacaggggatcccggctgttaaaattctaaccagtggtgcggcactgtttgcgtacatgtggaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattactggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4198 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNPTLHKALKMSAPNFSKILQNLKPDLVLYDFLQPWAEHVALEQGIPAVKILTSGAALFAYMWNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4199 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtacctcgattaacctcgaaagcatcaaaaagagaatcccggagaaatacagtaatagcatccatctggttgagctgcctctgccagaattaccggaactgccaccacattaccatactaccaacggtttaccaccgcatctgaacgctaccctgcacaaggcactgaagatgagcgctcccaactttagcaagatcctgcaaaacctgaagccggacctggtcctttacgattttctgcagccgtgggcagaacatgtcgccctagaacaggggatcccggctgttaaaattctaaccagtggtgcggcactgtttgcgtactttttcaacttcctgaagcgaccgggtcacgagtttccgtttccggcaatccgcctgtcgaagcgagaacaggtgaagatgcgcgagatgtttgaaaaggagccggatgaagaagatccgttagcgcctggcagctcgggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattactggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4200 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTSINLESIKKRIPEKYSNSIHLVELPLPELPELPPHYHTTNGLPPHLNATLHKALKMSAPNFSKILQNLKPDLVLYDFLQPWAEHVALEQGIPAVKILTSGAALFAYFFNFLKRPGHEFPFPAIRLSKREQVKMREMFEKEPDEEDPLAPGSSGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4201 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgcgattaacctcgaaagcatcaaaaagagaatcccggagaaatacagtaatagcatccatctggttgagctgcctctgccagaattaccggaactgccaccacattaccatactaccaacggtttaccaccgcatctgaacccgaccctgcacaaggcactgaagatgagcgctcccaactttagcaagatcctgcaaaacctgaagccggacctggtcctttacgattttctgcaaccgtgggcagaaaaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaactggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattactggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4202 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNPTLHKALKMSAPNFSKILQNLKPDLVLYDFLQPWAEKVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEELAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4203 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgcgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgataccgtgggcagaacatgtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattactggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4204 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLIPWAEHVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4205 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacccgaccctgcacaaggcactgaagatgagcgctcccaactttagcaagatcctgcaaaacctgaagccggacctggtcctttacgattttctgcagccgtgggcagaacatgtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttatcgcctggcagcgcgggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattactggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4206 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNPTLHKALKMSAPNFSKILQNLKPDLVLYDFLQPWAEHVALEQGIPAVKILTSGAALFSYFFNFLKRPGHEFPFPAIRLSKREQVKMREMFEKEPDEEDPLSPGSAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4207 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgcgattaacctcgaaagcatcaaaaagagaatcccggagaaatacagtaatagcatccatctggttgagctgcctctgccagaattaccggaactgccaccacattaccatactaccaacggtttaccaccgcatctgaacccgaccctgcacaaggcactgaagatgagcgctcccaactttagcaagatcctgcaaaacctgaagccggacctggtcctttacgattttctgcaaccgtgggcagaaaaggtcgccctagaacaggggatcccggctgttaaaattctaaccagtggtgcggcactgtttgcgtacatgttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4208 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNPTLHKALKMSAPNFSKILQNLKPDLVLYDFLQPWAEKVALEQGIPAVKILTSGAALFAYMFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4209 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgcgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcagccgtgggcagaacatgtcgccctagaacaggggatcccggctgttaaaattctaaccagtggtgcggcactgtttgcgtactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatctgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattcagggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4210 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEHVALEQGIPAVKILTSGAALFAYFFNFLKRPGHEFPFPAIRLSKREQVKMREMFEKEPDEEDPLAPGNAGIMLMCTSRVIEAKYLDYCTELTNVKVVPVGPPFQDLMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVIQGPTGEILRAKVRDISKNLRARREEEMNAAAEELIQLCRNRNAYK

SEQ ID NO: 4211 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgcgattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgttttcgtacatgttcaacttcctgaagcgaccgggtcacgagtttccgtttccggcaatccgcctgtcgaagcgagaacaggtgaagatgcgcgagatgtttgaaaaggagccggatgaagaagatccgttagcgcctggcagcgcgggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4212 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYMFNFLKRPGHEFPFPAIRLSKREQVKMREMFEKEPDEEDPLAPGSAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4213 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtacctcgattaacctcgaaagcatcaaaaagagaatcccggagaaatacagtaatagcatccatctggttgagctgcctctgccagaattaccggaactgccaccacattaccatactaccaacggtttaccaccgcatctgaacccgaccctgcacaaggcactgaagatgagcgctcccaactttagcaagatcctgcaaaacctgaagccggacctggtcctttacgattttctgcaaccgtgggcagaacatgtcgccctagaacaggggatcccggctgttaaaattctaaccagtggtgcggcactgtttgcgtacatgtggaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatctgatgaccgaagatatcgacgacaaagaactgattgattggttagataccaaacccgaaaacagtgttgtctatgtgtcgtttggcagcgaatacttcctgagccgtgaagatatggaagaactggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattcagggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4214 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTSINLESIKKRIPEKYSNSIHLVELPLPELPELPPHYHTTNGLPPHLNPTLHKALKMSAPNFSKILQNLKPDLVLYDFLQPWAEHVALEQGIPAVKILTSGAALFAYMWNFLKRPGHEFPFPAIRLSKREQVKMREMFEKEPDEEDPLAPGNAGIMLMCTSRVIEAKYLDYCTELTNVKVVPVGPPFQDLMTEDIDDKELIDWLDTKPENSVVYVSFGSEYFLSREDMEELAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVIQGPTGEILRAKVRDISKNLRARREEEMNAAAEELIQLCRNRNAYK

SEQ ID NO: 4215 - DNA, 1350 bp, Artificial Sequence
  "Variant of ADP-beta-1,2-glycosyltransferase"
atgcaccatcataatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaagttctaaccagtggtgcggcactgtttagctactttttcaacttcctgaagcgaccgggtcacgagtttccgtttccggcaatccgcctgtcgaagcgagaacaggtgaagatgcgcgagatgtttgaaagagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcgcgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggtcggattcaccgcggcgaaattgcccaagtcctgaaagatgtgattaccggccccactggtgagatcctgcgcgcgaaagtacgcgacattagcagaaacctgagagcgagacgcgaggaggaaatgaatgcagcggcggaagaactgatacagctgtgtcgcaaccgcaacgcctacaag

SEQ ID NO: 4216 - protein, 450 aa, Artificial Sequence
  "Variant of ADP-beta-1,2-glycosyltransferase"
MHHHNEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVKVLTSGAALFSYFFNFLKRPGHEFPFPAIRLSKREQVKMREMFEREPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISRNLRARREEEMNAAAEELIQLCRNRNAYK

SEQ ID NO: 4217 - DNA, 1350 bp, Artificial Sequence
  "Variant of ADP-beta-1,2-glycosyltransferase"
atgcaccatcataatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgccgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttaaagttctaaccagtggtgcggcactgtttagctactttttcaacttcctgaagcgaccgggtcacgagtttccgtttccggcaatccgcctgtcgaagcgagaacagactaagctgcgcgagatgtttgaaaaagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcagaaacctgagagcgagacgcgaggaggaaatgaatgcagcggcggaagaactgatacagctgtgtcgcaaccgcaacgcctacaag

SEQ ID NO: 4218 - protein, 450 aa, Artificial Sequence
  "Variant of ADP-beta-1,2-glycosyltransferase"
MHHHNEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKVLTSGAALFSYFFNFLKRPGHEFPFPAIRLSKREQTKLREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISRNLRARREEEMNAAAEELIQLCRNRNAYK

SEQ ID NO: 4219 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacagactaagctgcgcgagatgtttgcaaaagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaaactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4220 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQTKLREMFAKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4221 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttccgattctaaccagtggtgcggcactgtttagctactttttcaacttcctgaagcgaccgggtcacgagtttccgtttccggcaatccgcctgtcgaagcgagaacagactaagctgcgcgagatgtttggaagagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcagacgcctgagagcgagacgcgaggaggaaatgaatgcagcggcggaagaactgatacagctgtgtcgcaaccgcaacgcctacaag

SEQ ID NO: 4222 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVPILTSGAALFSYFFNFLKRPGHEFPFPAIRLSKREQTKLREMFGREPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISRRLRARREEEMNAAAEELIQLCRNRNAYK

SEQ ID NO: 4223 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggataagatgcgcgagatgtttgaaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcagaaacctgagagcgagacgcgaggaggaaatgaatgcagcggcggaagaactgatacagctgtgtcgcaaccgcaacgcctacaag

SEQ ID NO: 4224 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQDKMREMFETEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISRNLRARREEEMNAAAEELIQLCRNRNAYK

SEQ ID NO: 4225 - DNA, 1350 bp, Artificial Sequence
  "Variant of ADP-beta-1,2-glycosyltransferase"
atgcaccatcataatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttaaagttctaaccagtggtgcggcactgtttagctactttttcaacttcctgaagcgaccgggtcacgagtttccgtttccggcaatccgcctgtcgaagcgagaacaggataagatgcgcgagatgtttgcaaaagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4226 - protein, 450 aa, Artificial Sequence
  "Variant of ADP-beta-1,2-glycosyltransferase"
MHHHNEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVKVLTSGAALFSYFFNFLKRPGHEFPFPAIRLSKREQDKMREMFAKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4227 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgccgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttaaagttctaaccagtggtgcggcactgtttagctactttttcaacttcctgaagcgaccgggtcacgagtttccgtttccggcaatccgcctgtcgaagcgagaacagactaagctgcgcgagatgtttgcaagagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4228 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKVLTSGAALFSYFFNFLKRPGHEFPFPAIRLSKREQTKLREMFAREPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKNLRARREEEMNAAAEELIQLCRNRNAYK

SEQ ID NO: 4229 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgccgctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggataagctgcgcgagatgtttggaagagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaaactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4230 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQDKLREMFGREPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKRLRARREEEMNAAAEELIQLCRNRNAYK

SEQ ID NO: 4231 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatcattcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacagactaagctgcgcgagatgtttgcaagagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaaactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4232 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKIIQNLKPDLVLYDFLQPWAEQVALEQGIPAVKILTSGAALFSYFFNFLKRPGHEFPFPAIRLSKREQTKLREMFAREPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4233 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgccgctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggttaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4234 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4235 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacagactaagatgcgcgagatgtttgcaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4236 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQTKMREMFATEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4237 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgccgctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggttaagctgcgcgagatgtttggaagagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcagacgcctgagagcgagacgcgaggaggaaatgaatgcagcggcggaagaactgatacagctgtgtcgcaaccgcaacgcctacaag

SEQ ID NO: 4238 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKLREMFGREPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISRRLRARREEEMNAAAEELIQLCRNRNAYK

SEQ ID NO: 4239 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgccgctgccagaattaccggaactgccaccacattaccatactaccaacggtttaccaccgcatctgaacgggaccctgcacaaggcactgaagatgagcgctcccaactttagcaagatcattcaaaacctgaagccggacctggtcctttacgattttctgcaaccgtgggcagaacaggtcgccctagaacaggggatcccggctgttaaagttctaaccagtggtgcggcactgtttagctactttttcaacttcctgaagcgaccgggtcacgagtttccgtttccggcaatccgcctgtcgaagcgagaacaggtgaagatgcgcgagatgtttggaaaagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaaactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4240 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKIIQNLKPDLVLYDFLQPWAEQVALEQGIPAVKVLTSGAALFSYFFNFLKRPGHEFPFPAIRLSKREQVKMREMFGKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKRLRARREEEMNAAAEELIQLCRNRNAYK

SEQ ID NO: 4241 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttaaagttctaaccagtggtgcggcactgtttagctactttttcaacttcctgaagcgaccgggtcacgagtttccgtttccggcaatccgcctgtcgaagcgagaacagactaagatgcgcgagatgtttgcaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4242 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKVLTSGAALFSYFFNFLKRPGHEFPFPAIRLSKREQTKMREMFATEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKNLRARREEEMNAAAEELIQLCRNRNAYK

SEQ ID NO: 4243 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgccgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacagactaagctgcgcgagatgtttggaagagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaaactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcagaaacctgagagcgagacgcgaggaggaaatgaatgcagcggcggaagaactgatacagctgtgtcgcaaccgcaacgcctacaag

SEQ ID NO: 4244 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQTKLREMFGREPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISRNLRARREEEMNAAAEELIQLCRNRNAYK

SEQ ID NO: 4245 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcattcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcagaaacctgagagcgagacgcgaggaggaaatgaatgcagcggcggaagaactgatacagctgtgtcgcaaccgcaacgcctacaag

SEQ ID NO: 4246 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKIIQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISRNLRARREEEMNAAAEELIQLCRNRNAYK

SEQ ID NO: 4247 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatcattcaaaacctgaagccggacctggtcctttacgattttctgcaaccgtgggcagaacaggtcgccctagaacaggggatcccggctgttccgattctaaccagtggtgcggcactgtttagctactttttcaacttcctgaagcgaccgggtcacgagtttccgtttccggcaatccgcctgtcgaagcgagaacagactaagctgcgcgagatgtttgaaaaagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaaactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcagaaacctgagagcgagacgcgaggaggaaatgaatgcagcggcggaagaactgatacagctgtgtcgcaaccgcaacgcctacaag

SEQ ID NO: 4248 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKIIQNLKPDLVLYDFLQPWAEQVALEQGIPAVPILTSGAALFSYFFNFLKRPGHEFPFPAIRLSKREQTKLREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISRNLRARREEEMNAAAEELIQLCRNRNAYK

SEQ ID NO: 4249 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcattcaaaacctgaagccggacctggtcctttacgattttctgcaaccgtgggcagaacaggtcgccctagaacaggggatcccggctgttaaagttctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4250 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKIIQNLKPDLVLYDFLQPWAEQVALEQGIPAVKVLTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKNLRARREEEMNAAAEELIQLCRNRNAYK

SEQ ID NO: 4251 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggttaagctgcgcgagatgtttgcaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaaactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4252 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKLREMFATEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4253 - DNA, 1350 bp, Artificial Sequence
  "Variant of ADP-beta-1,2-glycosyltransferase"
atgcaccatcataatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgccgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacagactaagctgcgcgagatgtttggaagagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4254 - protein, 450 aa, Artificial Sequence
  "Variant of ADP-beta-1,2-glycosyltransferase"
MHHHNEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQTKLREMFGREPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKNLRARREEEMNAAAEELIQLCRNRNAYK

SEQ ID NO: 4255 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4256 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4257 - DNA, 1350 bp, Artificial Sequence
  "Variant of ADP-beta-1,2-glycosyltransferase"
atgcaccatcataatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgccgctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaagttctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcagaaacctgagagcgagacgcgaggaggaaatgaatgcagcggcggaagaactgatacagctgtgtcgcaaccgcaacgcctacaag

SEQ ID NO: 4258 - protein, 450 aa, Artificial Sequence
  "Variant of ADP-beta-1,2-glycosyltransferase"
MHHHNEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKVLTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISRNLRARREEEMNAAAEELIQLCRNRNAYK

SEQ ID NO: 4259 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgccgctgccagaattaccggaactgccaccacattaccatactaccaacggtttaccaccgcatctgaacgggaccctgcacaaggcactgaagatgagcgctcccaactttagcaagatcattcaaaacctgaagccggacctggtcctttacgattttctgcaaccgtgggcagaacaggtcgccctagaacaggggatcccggctgttccgattctaaccagtggtgcggcactgtttagctactttttcaacttcctgaagcgaccgggtcacgagtttccgtttccggcaatccgcctgtcgaagcgagaacaggataagatgcgcgagatgtttggaagagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaaactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4260 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKIIQNLKPDLVLYDFLQPWAEQVALEQGIPAVPILTSGAALFSYFFNFLKRPGHEFPFPAIRLSKREQDKMREMFGREPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4261 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggataagctgcgcgagatgtttggaagagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4262 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQDKLREMFGREPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKNLRARREEEMNAAAEELIQLCRNRNAYK

SEQ ID NO: 4263 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcattcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggttaagctgcgcgagatgtttgcaaaagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcagaaacctgagagcgagacgcgaggaggaaatgaatgcagcggcggaagaactgatacagctgtgtcgcaaccgcaacgcctacaag

SEQ ID NO: 4264 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKIIQNLKPDLVLYDFLQPWAEQVALEQGIPAVKILTSGAALFSYFFNFLKRPGHEFPFPAIRLSKREQVKLREMFAKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISRNLRARREEEMNAAAEELIQLCRNRNAYK

SEQ ID NO: 4265 - DNA, 1350 bp, Artificial Sequence
  "Variant of ADP-beta-1,2-glycosyltransferase"
atgcaccatcataatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaagagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaaactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcagaaacctgagagcgagacgcgaggaggaaatgaatgcagcggcggaagaactgatacagctgtgtcgcaaccgcaacgcctacaag

SEQ ID NO: 4266 - protein, 450 aa, Artificial Sequence
  "Variant of ADP-beta-1,2-glycosyltransferase"
MHHHNEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGREPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISRNLRARREEEMNAAAEELIQLCRNRNAYK

SEQ ID NO: 4267 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggataagctgcgcgagatgtttgcaaaagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcagaaacctgagagcgagacgcgaggaggaaatgaatgcagcggcggaagaactgatacagctgtgtcgcaaccgcaacgcctacaag

SEQ ID NO: 4268 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQDKLREMFAKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISRNLRARREEEMNAAAEELIQLCRNRNAYK

SEQ ID NO: 4269 - DNA, 1350 bp, Artificial Sequence
  "Variant of ADP-beta-1,2-glycosyltransferase"
atgcaccatcataatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatcattcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggttaagatgcgcgagatgtttggaagagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4270 - protein, 450 aa, Artificial Sequence
  "Variant of ADP-beta-1,2-glycosyltransferase"
MHHHNEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKIIQNLKPDLVLYDFLQPWAEQVALEQGIPAVKILTSGAALFSYFFNFLKRPGHEFPFPAIRLSKREQVKMREMFGREPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4271 - DNA, 1350 bp, Artificial Sequence
  "Variant of ADP-beta-1,2-glycosyltransferase"
atgcaccatcatcatgaaggcagcagcggccagttgctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4272 - protein, 450 aa, Artificial Sequence
  "Variant of ADP-beta-1,2-glycosyltransferase"
MHHHHEGSSGQLLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4273 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaatttaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4274 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTEFTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4275 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcggtgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4276 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCGELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4277 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgattaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4278 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPITEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4279 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaatccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4280 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLNPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4281 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatagtgatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4282 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDSDGRIHRGEIAQVLKDVITGPTGEILRAKVRDISKNLRARREEEMNAAAEELIQLCRNRNAYK

SEQ ID NO: 4283 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaacatagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4284 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKHRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4285 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtcatgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4286 - protein, 450 aa, Artificial Sequence
  "Variant of ADP-beta-1,2-glycosyltransferase"
MHHHHEGSSGQTLRVLMFPWLALGHVNPFLRIAKQLADRGHVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4287 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatctgatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcatgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4288 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNLIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4289 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcccttaag

SEQ ID NO: 4290 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNALK

SEQ ID NO: 4291 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgagtctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4292 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELSLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4293 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctatgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccggtgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4294 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPMPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPVTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4295 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcagcttccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4296 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQLPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4297 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccaaggtaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4298 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPRYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4299 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtcggagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4300 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSRSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4301 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggcactactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4302 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGTTGEILRAKVRDISKNLRARREEEMNAAAEELIQLCRNRNAYK

SEQ ID NO: 4303 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgctgatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4304 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDADGRIHRGEIAQVLKDVITGPTGEILRAKVRDISKNLRARREEEMNAAAEELIQLCRNRNAYK

SEQ ID NO: 4305 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctacgtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4306 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEATYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4307 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgggtaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4308 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPGTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4309 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaaggggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4310 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEGVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4311 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaagtcattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4312 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPSHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4313 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtcctgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4314 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRPEDGRIHRGEIAQVLKDVITGPTGEILRAKVRDISKNLRARREEEMNAAAEELIQLCRNRNAYK

SEQ ID NO: 4315 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcccataag

SEQ ID NO: 4316 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAHK

SEQ ID NO: 4317 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccggcgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4318 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPATEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4319 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacgtt

SEQ ID NO: 4320 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYV

SEQ ID NO: 4321 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaactggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4322 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPTGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4323 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaagggagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4324 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKGRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4325 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagggggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4326 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEGGRIHRGEIAQVLKDVITGPTGEILRAKVRDISKNLRARREEEMNAAAEELIQLCRNRNAYK

SEQ ID NO: 4327 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgcagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4328 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALQMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4329 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggcgcgattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4330 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGAIHRGEIAQVLKDVITGPTGEILRAKVRDISKNLRARREEEMNAAAEELIQLCRNRNAYK

SEQ ID NO: 4331 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatccatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4332 - protein, 450 aa, Artificial Sequence
  "Variant of ADP-beta-1,2-glycosyltransferase"
MHHHHEGSSGQTLRVLMFPWLALGHVNPFLRIAKQLADRGFVIHLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4333 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgcagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4334 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLQRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4335 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgatttcgggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4336 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVISGPTGEILRAKVRDISKNLRARREEEMNAAAEELIQLCRNRNAYK

SEQ ID NO: 4337 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccttattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4338 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGLIHRGEIAQVLKDVITGPTGEILRAKVRDISKNLRARREEEMNAAAEELIQLCRNRNAYK

SEQ ID NO: 4339 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattgggggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4340 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVIGGPTGEILRAKVRDISKNLRARREEEMNAAAEELIQLCRNRNAYK

SEQ ID NO: 4341 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacagaagatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4342 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQKIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4343 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgctctgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4344 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCSELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4345 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcagactccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4346 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQTPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4347 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgagtaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4348 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPSTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4349 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctcgttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaacggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4350 - protein, 450 aa, Artificial Sequence
  "Variant of ADP-beta-1,2-glycosyltransferase"
MHHHHEGSSGQTLRVLMFPWLALGHVNPFLRIAKQLADRGFVISLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFETEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4351 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtcagagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4352 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSQSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4353 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcggggtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4354 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4355 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggcgttattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4356 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGVIHRGEIAQVLKDVITGPTGEILRAKVRDISKNLRARREEEMNAAAEELIQLCRNRNAYK

SEQ ID NO: 4357 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacatgacattagcaaaaacctgagagcgagacgcgaggaggaaatgaatgcagcggcggaagaactgatacagctgtgtcgcaaccgcaacgcctacaag

SEQ ID NO: 4358 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVHDISKNLRARREEEMNAAAEELIQLCRNRNAYK

SEQ ID NO: 4359 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattactggactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4360 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYWTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4361 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccgaggaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4362 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVAEEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4363 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacagacgatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4364 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQTIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4365 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcggtgctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4366 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIGAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4367 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctattatgttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4368 - protein, 450 aa, Artificial Sequence
  "Variant of ADP-beta-1,2-glycosyltransferase"
MHHHHEGSSGQTLRVLMFPWLALGHVNPFLRIAKQLADRGFVIYYVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4369 - DNA, 1350 bp, Artificial Sequence
  "Variant of ADP-beta-1,2-glycosyltransferase"
atgcaccatcatcatgaaggcagcagcggcctgaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4370 - protein, 450 aa, Artificial Sequence
  "Variant of ADP-beta-1,2-glycosyltransferase"
MHHHHEGSSGLTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4371 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtagcggacattagcaaaaacctgagagcgagacgcgaggaggaaatgaatgcagcggcggaagaactgatacagctgtgtcgcaaccgcaacgcctacaag

SEQ ID NO: 4372 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVADISKNLRARREEEMNAAAEELIQLCRNRNAYK

SEQ ID NO: 4373 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctcattacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4374 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAHYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4375 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactggataatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4376 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELDNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4377 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctgtgggagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4378 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLWELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4379 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgcggaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4380 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPRTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4381 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcctcgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4382 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIPRGEIAQVLKDVITGPTGEILRAKVRDISKNLRARREEEMNAAAEELIQLCRNRNAYK

SEQ ID NO: 4383 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtggtagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4384 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSGSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4385 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagttgtagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4386 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSCSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4387 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcgggaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4388 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESGKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4389 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgtggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4390 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGVEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4391 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggtgccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4392 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQVPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4393 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgcatatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4394 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALHMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4395 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgattgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactaatacagctgtgtcgcaaccgcaacgcctacaag

SEQ ID NO: 4396 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMIEMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4397 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccttactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4398 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGLTGEILRAKVRDISKNLRARREEEMNAAAEELIQLCRNRNAYK

SEQ ID NO: 4399 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaccgagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4400 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKPRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4401 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagtgggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4402 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEVGRIHRGEIAQVLKDVITGPTGEILRAKVRDISKNLRARREEEMNAAAEELIQLCRNRNAYK

SEQ ID NO: 4403 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgattaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4404 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILINLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4405 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagctttatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4406 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSFILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4407 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgccagtaag

SEQ ID NO: 4408 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNASK

SEQ ID NO: 4409 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccacgtggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4410 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPRGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4411 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgctggagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4412 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMLEMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4413 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcttgaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4414 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESLKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4415 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgactcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4416 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLTRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4417 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgagtccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4418 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLSPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4419 - DNA, 1350 bp, Artificial Sequence
  "Variant of ADP-beta-1,2-glycosyltransferase"
atgcaccatcatcatgaaggcagcagcggccagattctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4420 - protein, 450 aa, Artificial Sequence
  "Variant of ADP-beta-1,2-glycosyltransferase"
MHHHHEGSSGQILRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4421 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattactcgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4422 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRITRGEIAQVLKDVITGPTGEILRAKVRDISKNLRARREEEMNAAAEELIQLCRNRNAYK

SEQ ID NO: 4423 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtaatggacattagcaaaaacctgagagcgagacgcgaggaggaaatgaatgcagcggcggaagaactgatacagctgtgtcgcaaccgcaacgcctacaag

SEQ ID NO: 4424 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVMDISKNLRARREEEMNAAAEELIQLCRNRNAYK

SEQ ID NO: 4425 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcccgtaag

SEQ ID NO: 4426 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNARK

SEQ ID NO: 4427 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagccttaacctgagagcgagacgcgaggaggaaatgaatgcagcggcggaagaactgatacagctgtgtcgcaaccgcaacgcctacaag

SEQ ID NO: 4428 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISLNLRARREEEMNAAAEELIQLCRNRNAYK

SEQ ID NO: 4429 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtacaggttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4430 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVQVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4431 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgagccggaaatgaatgcagcggcggaagaactgatacagctgtgtcgcaaccgcaacgcctacaag

SEQ ID NO: 4432 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREPEMNAAAEELIQLCRNRNAYK

SEQ ID NO: 4433 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcgctaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4434 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESAKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4435 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatccgtaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4436 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIRKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4437 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaat

SEQ ID NO: 4438 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYN

SEQ ID NO: 4439 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtcctagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4440 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSPSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4441 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcagtcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4442 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKISQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4443 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgattgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4444 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRLGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4445 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctggatcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4446 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLDRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4447 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtcgggaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4448 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRREDGRIHRGEIAQVLKDVITGPTGEILRAKVRDISKNLRARREEEMNAAAEELIQLCRNRNAYK

SEQ ID NO: 4449 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaaccccggaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4450 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPRNSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4451 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4452 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELHLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4453 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttctgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4454 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFLFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4455 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatctgtgctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4456 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGICAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4457 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagggtctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4458 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEGLRAKVRDISKNLRARREEEMNAAAEELIQLCRNRNAYK

SEQ ID NO: 4459 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcaataagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4460 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFNKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4461 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagcgtctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4462 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGERLRAKVRDISKNLRARREEEMNAAAEELIQLCRNRNAYK

SEQ ID NO: 4463 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggcagtattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4464 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGSIHRGEIAQVLKDVITGPTGEILRAKVRDISKNLRARREEEMNAAAEELIQLCRNRNAYK

SEQ ID NO: 4465 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctggggaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4466 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILGNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4467 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgacgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4468 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPTTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4469 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgaggtgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4470 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVEVPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4471 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacagtcgatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4472 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQSIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4473 - DNA, 1350 bp, Artificial Sequence
  "Variant of ADP-beta-1,2-glycosyltransferase"
atgcaccatcatcatgaaggcagcagcggcgataccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4474 - protein, 450 aa, Artificial Sequence
  "Variant of ADP-beta-1,2-glycosyltransferase"
MHHHHEGSSGDTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4475 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgtatgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4476 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMYEMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4477 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagctggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4478 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEAGRIHRGEIAQVLKDVITGPTGEILRAKVRDISKNLRARREEEMNAAAEELIQLCRNRNAYK

SEQ ID NO: 4479 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccatctggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4480 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPSGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4481 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgatgaggaaatgaatgcagcggcggaagaactgatacagctgtgtcgcaaccgcaacgcctacaag

SEQ ID NO: 4482 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARRDEEMNAAAEELIQLCRNRNAYK

SEQ ID NO: 4483 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcaggagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4484 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMQEMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4485 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtcaggaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4486 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRQEDGRIHRGEIAQVLKDVITGPTGEILRAKVRDISKNLRARREEEMNAAAEELIQLCRNRNAYK

SEQ ID NO: 4487 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaccgggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4488 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPPGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4489 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaattgggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4490 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDELGRIHRGEIAQVLKDVITGPTGEILRAKVRDISKNLRARREEEMNAAAEELIQLCRNRNAYK

SEQ ID NO: 4491 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatggtggagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcctacaag

SEQ ID NO: 4492 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMVEMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4493 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgcgcgagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgccggtaag

SEQ ID NO: 4494 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMREMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAGK

SEQ ID NO: 4495 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcctctgccagaattaccggaactgccaccacattaccatactaccaacggtttaccaccgcatctgaacgggaccctgcacaaggcactgaagatgagcgctcccaactttagcaagatcctgcaaaacctgaagccggacctggtcctttacgattttctgcaaccgtgggcagaacaggtcgccctagaacaggggatcccggctgttaaaattctaaccagtggtgcggcactgtttagctactttttcaacttcctgaagcgaccgggtcacgagtttccgtttccggcaatccgcctgtcgaagcgagaacaggtgaagatgacggagatgtttgaaaaggagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaaaacctgagagcgagacgcgaggaggaaatgaatgcagcggcggaagaactgatacagctgtgtcgcaaccgcaacgcatacaag

SEQ ID NO: 4496 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELPLPELPELPPHYHTTNGLPPHLNGTLHKALKMSAPNFSKILQNLKPDLVLYDFLQPWAEQVALEQGIPAVKILTSGAALFSYFFNFLKRPGHEFPFPAIRLSKREQVKMTEMFEKEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGPTGEILRAKVRDISKNLRARREEEMNAAAEELIQLCRNRNAYK

SEQ ID NO: 4497 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagccagccgcgaggaggaaatgaatgcagcggcggaagaactgatacagctgtgtcgcaaccgcaacgcctacaag

SEQ ID NO: 4498 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRASREEEMNAAAEELIQLCRNRNAYK

SEQ ID NO: 4499 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaagtacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttgcgtacatgtttaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagccacccgcgaggaggaaatgaatgcagcggcggaagaactgatacagctgtgtcgcaaccgcaacgcctacaag

SEQ ID NO: 4500 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFAYMFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRATREEEMNAAAEELIQLCRNRNAYK

SEQ ID NO: 4501 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaagtacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttgcgtacttctttaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaatcgattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4502 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFAYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4503 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgttttcgtacatgtggaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattacgggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4504 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYMWNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4505 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggaggcctacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttgcgtacatgtggaacttcgtgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaatcgattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4506 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEAYSNSIHLVELALPELPELPPHYHTTNGLPPHLNGTLHKALKMSAPNFSKILQNLKPDLVLYDFLQPWAEQVALEQGIPAVPVLTSGAALFAYMWNFVKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4507 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaagtacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttgcgtacttctggaacttcgtgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4508 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFAYFWNFVKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4509 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaagtacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttgcgtacatgtttaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatctgacgtttgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattcagggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4510 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFAYMFNFLKRPGHEFPFPAIRLSKREQDKMREMFGTEPDEEDPLAPGNAGIMLMCTSRVIEAKYLDYCTELTNVKVVPVGPPFQDLTFEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVIQGPTGEILRAKVRDISKRLRARREEEMNAAAEELIQLCRNRNAYK

SEQ ID NO: 4511 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaagtacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttgcgtacttctggaacttcctgaagcgaccgggtcacgagtttccgtttccggcaatccgcctgtcgaagcgggaacaggataagatgcgcgagatgtttggaacagagccggatgaagaagatccgttagcacctggcagcgccggtatcatgctgatgtgcacgagccgcgtaattgaggctaagtacctggactattgcaccgaactgaccaatgtaaaagttgttccggttggtccgccatttcaggatctgatgacggaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagccacgcgcgaggaggaaatgaatgcagcggcggaagaactgatacagctgtgtcgcaaccgcaacgcctacaag

SEQ ID NO: 4512 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFAYFWNFLKRPGHEFPFPAIRLSKREQDKMREMFGTEPDEEDPLAPGSAGIMLMCTSRVIEAKYLDYCTELTNVKVVPVGPPFQDLMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRATREEEMNAAAEELIQLCRNRNAYK

SEQ ID NO: 4513 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttgcgtacttctttaacttcgtgaagcgaccgggtcacgagtttccgtttccggcaatccgcctgtcgaagcgggaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatctgggaacggaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaagcgattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattacgggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4514 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFAYFFNFVKRPGHEFPFPAIRLSKREQDKMREMFGTEPDEEDPLAPGNAGIMLMCTSRVIEAKYLDYCTELTNVKVVPVGPPFQDLGTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMEAIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4515 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgttttcgtacttctggaacttcctgaagcgaccgggtcacgagtttccgtttccggcaatccgcctgtcgaagcgagaacaggataagatgcgcgagatgtttggaacagagccggatgaagaagatccgttagcacctggcagcgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagccacgcgcgaggaggaaatgaatgcagcggcggaagaactgatacagctgtgtcgcaaccgcaacgcctacaag

SEQ ID NO: 4516 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFWNFLKRPGHEFPFPAIRLSKREQDKMREMFGTEPDEEDPLAPGSAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRATREEEMNAAAEELIQLCRNRNAYK

SEQ ID NO: 4517 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaagtacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgttttcgtacttctggaacttcctgaagcgaccgggtcacgagtttccgtttccggcaatccgcctgtcgaagcgagaacaggataagatgcgcgagatgtttggaacagagccggatgaagaagatccgttagcacctggcagcgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4518 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFWNFLKRPGHEFPFPAIRLSKREQDKMREMFGTEPDEEDPLAPGSAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4519 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaagtacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttgcgtacttctggaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattacgggccccactggtgagatcctgcgcgcgaaagtacgcgacattagcaaacgcctgagagccacccgcgaggaggaaatgaatgcagcggcggaagaactgatacagctgtgtcgcaaccgcaacgcctacaag

SEQ ID NO: 4520 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFAYFWNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRATREEEMNAAAEELIQLCRNRNAYK

SEQ ID NO: 4521 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaagtacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgttttcgtacatgtggaacttcctgaagcgaccgggtcacgagtttccgtttccggcaatccgcctgtcgaagcaggaacaggataagctgcgcgagatgtttggaacagagccggatgaagaagatccgttagcacctggcagcgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4522 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYMWNFLKRPGHEFPFPAIRLSKQEQDKLREMFGTEPDEEDPLAPGSAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4523 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaagtacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgttttcgtacatgtggaacttcctgaagcgaccgggtcacgagtttccgtttccggcaatccgcctgtcgaagcaggaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgacgacggaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattacgggccccactggtgagatcctgcgcgcgaaagtacgcgacattagcaaacgcctgagagccagccgcgaggaggaaatgaatgcagcggcggaagaactgatacagctgtgtcgcaaccgcaacgcctacaag

SEQ ID NO: 4524 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYMWNFLKRPGHEFPFPAIRLSKQEQDKMREMFGTEPDEEDPLAPGNAGIMLMCTSRVIEAKYLDYCTELTNVKVVPVGPPFQDPTTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRASREEEMNAAAEELIQLCRNRNAYK

SEQ ID NO: 4525 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggaggcctacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttgcgtacatgtttaacttcctgaagcgaccgggtcacgagtttccgtttccggcaatccgcctgtcgaagcgggaacaggataagatgcgcgagatgtttggaacagagccggatgaagaagatccgttagcacctggcagcgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaatcgattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattcagggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4526 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEAYSNSIHLVELALPELPELPPHYHTTNGLPPHLNGTLHKALKMSAPNFSKILQNLKPDLVLYDFLQPWAEQVALEQGIPAVPVLTSGAALFAYMFNFLKRPGHEFPFPAIRLSKREQDKMREMFGTEPDEEDPLAPGSAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVIQGPTGEILRAKVRDISKRLRARREEEMNAAAEELIQLCRNRNAYK

SEQ ID NO: 4527 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttgcgtactttttcaacttcctgaagcgaccgggtcacgagtttccgtttccggcaatccgcctgtcgaagcaggaacaggataagctgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagccagccgcgaggaggaaatgaatgcagcggcggaagaactgatacagctgtgtcgcaaccgcaacgcctacaag

SEQ ID NO: 4528 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFAYFFNFLKRPGHEFPFPAIRLSKQEQDKLREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRASREEEMNAAAEELIQLCRNRNAYK

SEQ ID NO: 4529 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaagtacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttgcgtacatgtttaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgacgtttgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattacgggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4530 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFAYMFNFLKRPGHEFPFPAIRLSKREQDKMREMFGTEPDEEDPLAPGNAGIMLMCTSRVIEAKYLDYCTELTNVKVVPVGPPFQDPTFEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4531 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaagtacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgttttcgtacatgtttaacttcctgaagcgaccgggtcacgagtttccgtttccggcaatccgcctgtcgaagcgggaacaggataagctgcgcgagatgtttggaacagagccggatgaagaagatccgttagcacctggcagcgccggtatcatgctgatgtgcacgagccgcgtaattgaggctaagtacctggactattgcaccgaactgaccaatgtaaaagttgttccggttggtccgccatttcaggatccgggaacggaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaatcgattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattcagggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4532 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYMFNFLKRPGHEFPFPAIRLSKREQDKLREMFGTEPDEEDPLAPGSAGIMLMCTSRVIEAKYLDYCTELTNVKVVPVGPPFQDPGTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVIQGPTGEILRAKVRDISKRLRARREEEMNAAAEELIQLCRNRNAYK

SEQ ID NO: 4533 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaagtacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttgcgtacatgtggaacttcgtgaagcgaccgggtcacgagtttccgtttccggcaatccgcctgtcgaagcgagaacaggataagatgcgcgagatgtttggaacagagccggatgaagaagatccgttagcacctggcagcgccggtatcatgctgatgtgcacgagccgcgtaattgaggctaagtacctggactattgcaccgaactgaccaatgtaaaagttgttccggttggtccgccatttcaggatccgggaacggaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattcagggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4534 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFAYMWNFVKRPGHEFPFPAIRLSKREQDKMREMFGTEPDEEDPLAPGSAGIMLMCTSRVIEAKYLDYCTELTNVKVVPVGPPFQDPGTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVIQGPTGEILRAKVRDISKRLRARREEEMNAAAEELIQLCRNRNAYK

SEQ ID NO: 4535 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggaggcctacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttgcgtacatgtggaacttcgtgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagccacgcgcgaggaggaaatgaatgcagcggcggaagaactgatacagctgtgtcgcaaccgcaacgcctacaag

SEQ ID NO: 4536 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEAYSNSIHLVELALPELPELPPHYHTTNGLPPHLNGTLHKALKMSAPNFSKILQNLKPDLVLYDFLQPWAEQVALEQGIPAVPVLTSGAALFAYMWNFVKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRATREEEMNAAAEELIQLCRNRNAYK

SEQ ID NO: 4537 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaagtacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttgcgtacatgtggaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4538 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFAYMWNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4539 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtgaggagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatggacgcagcggcggaagaactgatacagctgtgtcgcaaccgcaacgcctacaag

SEQ ID NO: 4540 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGEEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMDAAAEELIQLCRNRNAYK

SEQ ID NO: 4541 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4542 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAYK

SEQ ID NO: 4543 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctgtcaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacgggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagggcgatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 4544 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAVNLESIKKRIPEKYSNSIHLVELALPELPELPPHYHTTNGLPPHLNGTLHKALKMSAPNFSKILQNLKPDLVLYDFLQPWAEQVALERGIPAVPVLTSGAALFSYFFNFLKRPGHEFPFPAIRLSKREQDKMREMFGTEGDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAYK

SEQ ID NO: 4545 - DNA, 1350 bp, Artificial Sequence
  "Variant of ADP-beta-1,2-glycosyltransferase"
atgcaccaccatcatgaaggctcgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactggccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4546 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELANVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAYK

SEQ ID NO: 4547 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacgggggatcccggctgttccggttctaaccagtggtgcggcactgtttagctactttttcaacttcctgaagcgaccgggtgaggagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4548 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALERGIPAVPVLTSGAALFSYFFNFLKRPGEEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAYK

SEQ ID NO: 4549 - DNA, 1350 bp, Artificial Sequence
  "Variant of ADP-beta-1,2-glycosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 4550 - protein, 450 aa, Artificial Sequence
  "Variant of ADP-beta-1,2-glycosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAYK

SEQ ID NO: 4551 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgccaagaag

SEQ ID NO: 4552 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAKK

SEQ ID NO: 4553 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagctcgcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4554 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSSPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4555 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgccgtcgcaacgcctacaag

SEQ ID NO: 4556 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRRRNAYK

SEQ ID NO: 4557 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaactggatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4558 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDELDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4559 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgtggggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4560 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAWGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4561 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttgggaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4562 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFGKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4563 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacattaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4564 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNIKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4565 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaagcgctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4566 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQALKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4567 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcaagcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4568 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSKPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4569 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacgggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4570 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAERVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4571 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgagggtacgcgacattagcaaacgcctgagagcgagacgcgaggaggaaatgaatgcagcggcggaagaactgatacagctgtgtcgcaaccgcaacgcctacaag

SEQ ID NO: 4572 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRARVRDISKRLRARREEEMNAAAEELIQLCRNRNAYK

SEQ ID NO: 4573 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcccagaag

SEQ ID NO: 4574 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAQK

SEQ ID NO: 4575 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatctcgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4576 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEISRDEDGRIHRGEIAQVLKDVITGPTGEILRAKVRDISKRLRARREEEMNAAAEELIQLCRNRNAYK

SEQ ID NO: 4577 - DNA, 1350 bp, Artificial Sequence
  "Variant of ADP-beta-1,2-glycosyltransferase"
atgcaccatcatcatgaaggcagcggtggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4578 - protein, 450 aa, Artificial Sequence
  "Variant of ADP-beta-1,2-glycosyltransferase"
MHHHHEGSGGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4579 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcaggcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4580 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSRPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4581 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcagtgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4582 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCSELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4583 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcgtaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4584 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLRKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4585 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgccaggaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4586 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCQELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4587 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaagcgcaacgcctacaag

SEQ ID NO: 4588 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRKRNAYK

SEQ ID NO: 4589 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagccgctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4590 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQPLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4591 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgccaggaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4592 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRQEIAQVLKDVITGPTGEILRAKVRDISKRLRARREEEMNAAAEELIQLCRNRNAYK

SEQ ID NO: 4593 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagttttagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4594 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSFSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4595 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcccgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4596 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIPRDEDGRIHRGEIAQVLKDVITGPTGEILRAKVRDISKRLRARREEEMNAAAEELIQLCRNRNAYK

SEQ ID NO: 4597 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagctgatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4598 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEADPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4599 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaattcgggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4600 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNSGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4601 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcatgtcaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4602 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWACQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4603 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaactgctgagagcgagacgcgaggaggaaatgaatgcagcggcggaagaactgatacagctgtgtcgcaaccgcaacgcctacaag

SEQ ID NO: 4604 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKLLRARREEEMNAAAEELIQLCRNRNAYK

SEQ ID NO: 4605 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcttggcctacaag

SEQ ID NO: 4606 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRLAYK

SEQ ID NO: 4607 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctaaggcaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4608 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALRQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4609 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcccggaag

SEQ ID NO: 4610 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNARK

SEQ ID NO: 4611 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagagtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4612 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQSLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4613 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcaagtcaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4614 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWASQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4615 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaactctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4616 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQTLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4617 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatcggagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4618 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHRSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4619 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctagcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaaccggatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4620 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEPDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4621 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaaccagaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgccaaggtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4622 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAKVLKDVITGPTGEILRAKVRDISKRLRARREEEMNAAAEELIQLCRNRNAYK

SEQ ID NO: 4623 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgttgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4624 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPLTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4625 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacccggaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4626 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4627 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4628 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPTEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4629 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaacggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4630 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAETVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4631 - DNA, 1350 bp, Artificial Sequence
  "Variant of ADP-beta-1,2-glycosyltransferase"
atgcaccatcatcatgaaggcagcagcggccagtctctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4632 - protein, 450 aa, Artificial Sequence
  "Variant of ADP-beta-1,2-glycosyltransferase"
MHHHHEGSSGQSLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4633 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagcggctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4634 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGERLRAKVRDISKRLRARREEEMNAAAEELIQLCRNRNAYK

SEQ ID NO: 4635 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctgattgacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4636 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLIDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4637 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccatgaagatatggaagaagtcgcgttcggcctggagctgagtaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4638 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSHEDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4639 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgattaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4640 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPITEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4641 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggagatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4642 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPEIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4643 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccataagagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4644 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHKSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4645 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcatggaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4646 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCMELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4647 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatcattctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4648 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIILVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4649 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctatctcaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4650 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALSQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4651 - DNA, 1350 bp, Artificial Sequence
  "Variant of ADP-beta-1,2-glycosyltransferase"
atgcaccatcatcatgaaggcagcagcgatcagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4652 - protein, 450 aa, Artificial Sequence
  "Variant of ADP-beta-1,2-glycosyltransferase"
MHHHHEGSSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4653 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccaatgaccgaagatatcgacgacaaagaactgattgattggttagataccaaacccgaacatagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4654 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPEHSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4655 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaattggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4656 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKRELDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4657 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagattttttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4658 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDFLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4659 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgcgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4660 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIARDEDGRIHRGEIAQVLKDVITGPTGEILRAKVRDISKRLRARREEEMNAAAEELIQLCRNRNAYK

SEQ ID NO: 4661 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgccttgaag

SEQ ID NO: 4662 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNALK

SEQ ID NO: 4663 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatctgtcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4664 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEICRDEDGRIHRGEIAQVLKDVITGPTGEILRAKVRDISKRLRARREEEMNAAAEELIQLCRNRNAYK

SEQ ID NO: 4665 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagggcaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4666 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALGQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4667 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatttggacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4668 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDLDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4669 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggcgagactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4670 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGETGEILRAKVRDISKRLRARREEEMNAAAEELIQLCRNRNAYK

SEQ ID NO: 4671 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagatcaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4672 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALDQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4673 - DNA, 1350 bp, Artificial Sequence
  "Variant of ADP-beta-1,2-glycosyltransferase"
atgcaccatcatcatgaacatagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4674 - protein, 450 aa, Artificial Sequence
  "Variant of ADP-beta-1,2-glycosyltransferase"
MHHHHEHSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4675 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgccatcgcaacgcctacaag

SEQ ID NO: 4676 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRHRNAYK

SEQ ID NO: 4677 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgcgtgatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4678 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLRDVITGPTGEILRAKVRDISKRLRARREEEMNAAAEELIQLCRNRNAYK

SEQ ID NO: 4679 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcaatagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4680 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLNSIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4681 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaggggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgatcgtggaattaggcgttgcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaatgcagcggcggaagaactgatacagctgtgtcgcaaccgcaacgcctacaag

SEQ ID NO: 4682 - protein, 450 aa, Artificial Sequence
  "Variant of ADP-beta-1,2-glycosyltransferase"
MHHHHEGSSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEGVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLIVELGVAVEIVRDEDGRIHRGEIAQVLKDVITGPTGEILRAKVRDISKRLRARREEEMNAAAEELIQLCRNRNAYK

SEQ ID NO: 4683 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgagcgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4684 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPSVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4685 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaagttaaagatcttaagcgcgcgtatagcaattggcagattgctaaagaaattctggataagaagattgctcagacccgtgcgagcagcggtgtgatttggaacagctttaaagagctggaggaaagcgagctggagaccgtttggcgtgaaattccggcgccgagcttcctgattccgctgccgaaacacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcatttgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4686 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDLKRAYSNWQIAKEILDKKIAQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESICEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4687 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgagagttaaagatattaagcgcgcgtatagcaattggcagattgcgaaagaaattctggataagatgattgctcagacccgtgcgagcagcggtgtgatttggaacagctttaaagagctggaggaaagcgagctgtcgaccgtttggcgtgaaattccggcgccgagcttcctgattccgctgccgaagcacctgagggcgaacagcagcaacctgctggaccacgatccgaccgtgttccagtggctggaccagcaaccgccgagcagcgtgctgtacgttagctttggcagccagagcgaggtggacgaaaaggaattcctggagattgcgcgtggtctggttgacagcaaacaatcgtttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcatttgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4688 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLRVKDIKRAYSNWQIAKEILDKMIAQTRASSGVIWNSFKELEESELSTVWREIPAPSFLIPLPKHLRANSSNLLDHDPTVFQWLDQQPPSSVLYVSFGSQSEVDEKEFLEIARGLVDSKQSFLWRVRPGFVKGSEWVEPLPDGFLGERGRIVKSVPQQEVLAHDAIGAFWTHGGWNGTLESICEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4689 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaatcgtttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcatttgcgaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtctgatggttgaccgtgaaggtgaggtgatgcgtcaaaacgcggcggttctgaaggataaagcggatcagagcctggctaagggtggcagcagctacgagagcctggaaagcctggttagctatattagcagcctg

SEQ ID NO: 4690 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESICEGVPMIFSDFGLDQPLNARYMSDVLKVGVYLENGLERGEIENAIRRLMVDREGEVMRQNAAVLKDKADQSLAKGGSSYESLESLVSYISSL

SEQ ID NO: 4691 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaagttaaagatattaagcgcgcgtatagcaattggcagattgctaaagaaattctggataagatgattgctcagacccgtgcgagcagcggtgtgatttggaacagctttaaagagctggaggaaagcgagctggagaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagttttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcatttgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatcagagcctggctaagggtggcagcagctacgagagcctggaaagcctggttagctatattagcagcctg

SEQ ID NO: 4692 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIAQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESICEGVPMIFSDFGLDQPLNARYMSDVLKVGVYLENGWERGEIENAIRRVMVDREGEVMRQNAAVLKDKADQSLAKGGSSYESLESLVSYISSL

SEQ ID NO: 4693 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaagttaaagatattaagcgcgcgtatagcaattggcagattgctaaagaaattctggataagatgattaagcagacccgtgcgagcagcggtgtgatttggaacagctttaaagagctggaggaaagcgagctggagaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaccgtttctgtggcgcgttcgtccgggcttcgtgaagggtagcgagtgggttgagtcgctgccggatggttttctgggcgaacgtggtcgtatcgtgaagtctgttccgcaacaagaagtgctggcgcacgatgcgattggtgcgttctggacccacggcggttggaacggcaccctggagagcatttgcgaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4694 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQPFLWRVRPGFVKGSEWVESLPDGFLGERGRIVKSVPQQEVLAHDAIGAFWTHGGWNGTLESICEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4695 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacaatagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccaatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4696 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHNRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4697 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacatgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4698 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHMRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4699 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgagggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4700 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPRDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4701 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacagtagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4702 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHSRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4703 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgttgccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4704 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4705 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgcgccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4706 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4707 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaatgaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4708 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIANEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4709 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcactatagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4710 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHYRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4711 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggtttgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4712 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWFVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4713 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttgatcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4714 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVDQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4715 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacgagagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4716 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHERASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4717 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaactttccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4718 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNFPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4719 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaaccggccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4720 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNRPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4721 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacattagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4722 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHIRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4723 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggaagatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4724 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWKIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4725 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaaccagccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4726 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNQPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4727 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacattccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4728 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNIPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4729 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtggcggaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4730 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVAEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4731 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgcagtggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4732 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAQWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4733 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccggggccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4734 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPGPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4735 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacgggccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4736 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNGPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4737 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacgttaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4738 - protein, 457 aa, Artificial Sequence
  "Variant of ADP-beta-1,3-glucosyltransferase"
MENKTETTVRRRRVILFPVPFPGHVNPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4739 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacaagccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4740 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNKPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4741 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacatgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4742 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNMPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4743 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttacggatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4744 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFTDFGLDQPLNARYMSDVLKVGVYLENGWERGEIENAIRRVMVDREGEVMRQNAAVLKDKADVSLAKGGSSYESLESLVSYISSL

SEQ ID NO: 4745 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacactagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4746 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHTRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4747 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacccgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4748 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNPPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4749 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgtctgaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4750 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIASEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4751 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4752 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4753 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggtatgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4754 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWYVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4755 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggactatgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4756 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDYDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4757 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggactctgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4758 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDSDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4759 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgctgcatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4760 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPLHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4761 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtggctgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4762 - protein, 457 aa, Artificial Sequence; identical to SEQ ID NO: 4730
  "Variant of ADP-beta-1,3-glucosyltransferase"

SEQ ID NO: 4763 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttccttggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4764 - protein, 457 aa, Artificial Sequence
  "Variant of ADP-beta-1,3-glucosyltransferase"
MENKTETTVRRRRVILFPVPFLGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4765 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgatgccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4766 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLMPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4767 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacctgaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4768 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4769 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcaccatagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4770 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHHRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4771 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgtgtccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4772 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLCPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4773 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttggttttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4774 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVGFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4775 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggacggtgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4776 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDGDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4777 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcaccctagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4778 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHPRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4779 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgtatccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4780 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLYPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4781 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaaccctccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4782 - protein, 457 aa, Artificial Sequence; identical to SEQ ID NO: 4748
  "Variant of ADP-beta-1,3-glucosyltransferase"

SEQ ID NO: 4783 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccacggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4784 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTTESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4785 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttgggtgatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4786 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWVIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4787 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacgagccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4788 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNEPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4789 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacctgtggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4790 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTCGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4791 - DNA, 1371 bp, Artificial Sequence; identical to SEQ ID NO: 4735
  "Variant of ADP-beta-1,3-glucosyltransferase"

SEQ ID NO: 4792 - protein, 457 aa, Artificial Sequence; identical to SEQ ID NO: 4736
  "Variant of ADP-beta-1,3-glucosyltransferase"

SEQ ID NO: 4793 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctggttccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4794 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLVPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4795 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgggtccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgcccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4796 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSGPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4797 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctggtgccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4798 - protein, 457 aa, Artificial Sequence; identical to SEQ ID NO: 4794
  "Variant of ADP-beta-1,3-glucosyltransferase"

SEQ ID NO: 4799 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggattatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4800 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWIIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4801 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggggtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4802 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLEGVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4803 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcactcagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4804 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4805 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagactgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4806 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGSQTEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4807 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtcttgtccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4808 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSCPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4809 - DNA, 1371 bp, Artificial Sequence; identical to SEQ ID NO: 4801
  "Variant of ADP-beta-1,3-glucosyltransferase"

SEQ ID NO: 4810 - protein, 457 aa, Artificial Sequence; identical to SEQ ID NO: 4802
  "Variant of ADP-beta-1,3-glucosyltransferase"

SEQ ID NO: 4811 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaaccctatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggtgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgcagccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4812 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSQPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 4813 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacatgagggcgagcagcagcagcctgctggaccacgatccgagcgtgttccagtggctggaccagcaaccgccgagcagcgtgctgtacgttagctttggcagccagaccgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctacacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4814 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHMRASSSSLLDHDPSVFQWLDQQPPSSVLYVSFGSQTEVDEKDFLEIARGLVDSKQSFLWRVRPGFVKGSEWVEPLPDGFLGERGRIVKSVPQQEVLAHDAIGAFYTHGGWNGTLESVCEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4815 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgcgccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcagccagagcgaggtggacgaaaaggatttcctggagattgcgcgtggtctggttgacagcaaacaaagctttctgtggtttgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctacacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4816 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGSQSEVDEKDFLEIARGLVDSKQSFLWFVRPGFVKGSEWVEPLPDGFLGERGRIVKSVPQQEVLAHDAIGAFYTHGGWNGTLESVCEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4817 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgcgccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacatgagggcgagcagcagcagcctgctggaccacgatccgagcgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagagcgtgtccgaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4818 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHMRASSSSLLDHDPSVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTMESVSEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4819 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgcgccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcactatagggcgagcagcagcagcctgctggaccacgatccgagcgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctacacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4820 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHYRASSSSLLDHDPSVFQWLDQQPPSSVLYVSFGSQSEVDEKDFLEIARGLVDSKQSFLWRVRPGFVKGSEWVEPLPDGFLGERGRIVKSVPQQEVLAHDAIGAFYTHGGWNGTLESVCEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4821 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacctgagggcgagcagcagcagcctgctggaccacgatccgagcgtgttccagtggctggaccagcaaccgccgagcagcgtgctgtacgttagctttggcagccagagcgaggtggacgaaaaggatttcctggagattgcgcgtggtctggttgacagcaaacaaagctttctgtggtttgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctacacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4822 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHLRASSSSLLDHDPSVFQWLDQQPPSSVLYVSFGSQSEVDEKDFLEIARGLVDSKQSFLWFVRPGFVKGSEWVEPLPDGFLGERGRIVKSVPQQEVLAHDAIGAFYTHGGWNGTLESVCEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4823 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgcgccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcactatagggcgagcagcagcagcctgctggaccacgatccgagcgtgttccagtggctggaccagcaaccgccgagcagcgtgctgtacgttagctttggcagccagaccgaggtggacgaaaaggatttcctggagattgcgcgtggtctggttgacagcaaacaaagctttctgtggtttgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagagcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4824 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHYRASSSSLLDHDPSVFQWLDQQPPSSVLYVSFGSQTEVDEKDFLEIARGLVDSKQSFLWFVRPGFVKGSEWVEPLPDGFLGERGRIVKSVPQQEVLAHDAIGAFWTHGGWNGTMESVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4825 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgcgccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacatgagggcgagcagcagcagcctgctggaccacgatccgagcgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtgtgcgaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4826 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHMRASSSSLLDHDPSVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTMEGVCEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4827 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgcgccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcagccagagcgaggtggacgaaaaggatttcctggagattgcgcgtggtctggttgacagcaaacaaagctttctgtggtttgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtgtgcgaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4828 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGSQSEVDEKDFLEIARGLVDSKQSFLWFVRPGFVKGSEWVEPLPDGFLGERGRIVKSVPQQEVLAHDAIGAFWTHGGWNGTMEGVCEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4829 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacctgagggcgagcagcagcagcctgctggaccacgatccgagcgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4830 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHLRASSSSLLDHDPSVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4831 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacatgagggcgagcagcagcagcctgctggaccacgatccgagcgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctacacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4832 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHMRASSSSLLDHDPSVFQWLDQQPPSSVLYVSFGSQSEVDEKDFLEIARGLVDSKQSFLWRVRPGFVKGSEWVEPLPDGFLGERGRIVKSVPQQEVLAHDAIGAFYTHGGWNGTLESVCEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4833 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcactatagggcgagcagcagcagcctgctggaccacgatccgagcgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4834 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHYRASSSSLLDHDPSVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4835 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgagcgtgttccagtggctggaccagcaaccgccgagcagcgtgctgtacgttagctttggcagccagagcgaggtggacgaaaaggatttcctggagattgcgcgtggtctggttgacagcaaacaaagctttctgtggtttgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4836 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPSVFQWLDQQPPSSVLYVSFGSQSEVDEKDFLEIARGLVDSKQSFLWFVRPGFVKGSEWVEPLPDGFLGERGRIVKSVPQQEVLAHDAIGAFWTHGGWNGTLESVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4837 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4838 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4839 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgcgccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacatgagggcgagcagcagcagcctgctggaccacgatccgagcgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4840 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHMRASSSSLLDHDPSVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4841 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgagcgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4842 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPSVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4843 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgcgccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacatgagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctacacccacggcggttggaacggcaccctggagagcgtgtccgaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4844 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHMRASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFYTHGGWNGTLESVSEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4845 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgcgccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacgagagggcgagcagcagcagcctgctggaccacgatccgagcgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctacacccacggcggttggaacggcaccatggagggcgtgtgcgaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4846 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHERASSSSLLDHDPSVFQWLDQQPPSSVLYVSFGSQSEVDEKDFLEIARGLVDSKQSFLWRVRPGFVKGSEWVEPLPDGFLGERGRIVKSVPQQEVLAHDAIGAFYTHGGWNGTMEGVCEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4847 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgagcgtgttccagtggctggaccagcaaccgccgagcagcgtgctgtacgttagctttggcagccagaccgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4848 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPSVFQWLDQQPPSSVLYVSFGSQTEVDEKDFLEIARGLVDSKQSFLWRVRPGFVKGSEWVEPLPDGFLGERGRIVKSVPQQEVLAHDAIGAFWTHGGWNGTLESVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4849 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacctgagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctacacccacggcggttggaacggcaccatggagggcgtgtgcgaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4850 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHLRASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFYTHGGWNGTMEGVCEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4851 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgcgccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgagcgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctacacccacggcggttggaacggcaccatggagagcgtgtgcgaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4852 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPSVFQWLDQQPPSSVLYVSFGSQSEVDEKDFLEIARGLVDSKQSFLWRVRPGFVKGSEWVEPLPDGFLGERGRIVKSVPQQEVLAHDAIGAFYTHGGWNGTMESVCEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4853 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgcgccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgagcgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4854 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPSVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4855 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagaccgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtgtccgaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4856 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQTEVDEKDFLEIARGLVDSKQSFLWRVRPGFVKGSEWVEPLPDGFLGERGRIVKSVPQQEVLAHDAIGAFWTHGGWNGTMEGVSEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4857 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4858 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4859 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacatgagggcgagcagcagcagcctgctggaccacgatccgagcgtgttccagtggctggaccagcaaccgccgagcagcgtgctgtacgttagctttggcagccagagcgaggtggacgaaaaggatttcctggagattgcgcgtggtctggttgacagcaaacaaagctttctgtggtttgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctacacccacggcggttggaacggcaccctggagagcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4860 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHMRASSSSLLDHDPSVFQWLDQQPPSSVLYVSFGSQSEVDEKDFLEIARGLVDSKQSFLWFVRPGFVKGSEWVEPLPDGFLGERGRIVKSVPQQEVLAHDAIGAFYTHGGWNGTLESVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4861 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgcgccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctacacccacggcggttggaacggcaccatggagagcgtgtccgaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4862 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFYTHGGWNGTMESVSEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4863 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacctgagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4864 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHLRASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4865 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgcgccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacatgagggcgagcagcagcagcctgctggaccacgatccgagcgtgttccagtggctggaccagcaaccgccgagcagcgtgctgtacgttagctttggcacccagaccgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtgtgcgaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4866 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHMRASSSSLLDHDPSVFQWLDQQPPSSVLYVSFGTQTEVDEKDFLEIARGLVDSKQSFLWRVRPGFVKGSEWVEPLPDGFLGERGRIVKSVPQQEVLAHDAIGAFWTHGGWNGTLEGVCEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4867 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcactatagggcgagcagcagcagcctgctggaccacgatccgagcgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctacacccacggcggttggaacggcaccatggagagcgtgtccgaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4868 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHYRASSSSLLDHDPSVFQWLDQQPPSSVLYVSFGSQSEVDEKDFLEIARGLVDSKQSFLWRVRPGFVKGSEWVEPLPDGFLGERGRIVKSVPQQEVLAHDAIGAFYTHGGWNGTMESVSEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4869 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgagcgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagagcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4870 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPSVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTMESVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4871 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggaccacgatccgagcgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctacacccacggcggttggaacggcaccatggagagcgtgtccgaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4872 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHYRASSSSLLDHDPSVFQWLDQQPPSSVLYVSFGSQSEVDEKDFLEIARGLVDSKQSFLWRVRPGFVKGSEWVEPLPDGFLGERGRIVKSVPQQEVLAHDAIGAFYTHGGWNGTMESVSEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4873 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgcgccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgattcgattggtgcgttctggacccacggcggttggaacggcaccatggagagcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4874 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGSQSEVDEKDFLEIARGLVDSKQSFLWRVRPGFVKGSEWVEPLPDGFLGERGRIVKSVPQQEVLAHDSIGAFWTHGGWNGTMESVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4875 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4876 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4877 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcttcagaaattctggataagatgattaagcagacccgtgcgagcagcggtgtgatttggaacagctttaaagagctggaggaaagcgagctggaaaccgtttggcgtgaaattccggcgccgagcttcctgatgccgctaccgaagcacataagggcgagcagcagcagcctgctggacggagatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgtgttcgtccgggcttcgtgaagggtagcgagtgggttgagccgctgccggatggttttctgggcgaacgtggtcgtatcgtgaagtcttgtcctcaacaagaagtgctggcgcacgatgcgattggtgcgttttggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4878 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIASEILDKMIKQTRASSGVIWNSFKELEESELETVWREIPAPSFLMPLPKHIRASSSSLLDGDPSVFQWLDQQPPSSVLYVSFGTQSEVDEKDFLEIARGLVDSKQSFLWRVRPGFVKGSEWVEPLPDGFLGERGRIVKSCPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4879 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgatgccgctaccgaagcacgaaagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgtcctcaacaagaagtgctggcgcacgatgcgattggtgcgttctggacccacggcggttggaacggcaccatggagggcgtgtcagaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4880 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLMPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSCPQQEVLAHDAIGAFWTHGGWNGTMEGVSEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4881 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcttcagaaattctggataagatgattaagcagacccgtgcgagcagcggtgtgatttggaacagctttaaagagctggaggaaagcgagctggaaaccgtttggcgtgaaattccggcgccgagcttcctgatgccgctaccgaagcactacagggcgagcagcagcagcctgctggacggagatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttttggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4882 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIASEILDKMIKQTRASSGVIWNSFKELEESELETVWREIPAPSFLMPLPKHYRASSSSLLDGDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4883 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgatgccgctaccgaagcacatgagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4884 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLMPLPKHMRASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4885 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacaagccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccatgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttttatacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4886 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNKPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFYTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4887 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaaaccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgatgccgctaccgaagcactacagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgtgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttttggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4888 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLMPLPKHYRASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4889 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttttatacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4890 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFYTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4891 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacattaacccgatgctgcaactggcgaacgtgctgtacagcagaggttttagcatcaccatttttcacaccaacttcaacaagccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgtgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4892 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4893 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacgttaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgtgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtgtcagaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4894 - protein, 457 aa, Artificial Sequence
  "Variant of ADP-beta-1,3-glucosyltransferase"
MENKTETTVRRRRVILFPVPFPGHVNPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVSEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4895 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacattaacccgatgctgcaactggcgaacgtgctgtacagcagaggttttagcatcaccatttttcacaccaacttcaacgccccgaaaaccagccattatccgcacttcacctttcgttttatcttggacaacgatccgcgggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctaccgaagcacatgagggcgagcagcagcagcctgctggaccacgatccgagcgtgttccagtggctggaccagcaaccgccgagcagcgtgctgtacgttggctttggcacccagaccgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttttggacccacggcggttggaacggcaccatggagggcgtgtcagaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4896 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSHYPHFTFRFILDNDPRDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHMRASSSSLLDHDPSVFQWLDQQPPSSVLYVGFGTQTEVDEKDFLEIARGLVDSKQSFLWRVRPGFVKGSEWVEPLPDGFLGERGRIVKSVPQQEVLAHDAIGAFWTHGGWNGTMEGVSEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4897 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacgttaacccgatgctgcaactggcgaacgtgctgtacagcagaggttttagcatcaccatttttcacaccaacttcaacaaaccgaaaaccagccattatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgatgccgctaccgaagcacataagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4898 - protein, 457 aa, Artificial Sequence
  "Variant of ADP-beta-1,3-glucosyltransferase"
MENKTETTVRRRRVILFPVPFPGHVNPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLMPLPKHIRASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4899 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacgttaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgatgccgctaccgaagcactacagggcgagcagcagcagcctgctggacggagatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccttggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4900 - protein, 457 aa, Artificial Sequence
  "Variant of ADP-beta-1,3-glucosyltransferase"
MENKTETTVRRRRVILFPVPFPGHVNPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLMPLPKHYRASSSSLLDGDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4901 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4902 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4903 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaacagatttcctggagattgcgcggggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgaaagcctggaaagcctggttagctatattagcagcctg

SEQ ID NO: 4904 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDETDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4905 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtatagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcggatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaaggaaacccgtgcgagcagcggtgtgatttggaacagctttaaagagctggaggaaagcgagctggaaaccgtttggcaggaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaatgcgattcgtcgtgtgatggttgaccgtgaaggtgaagtgatgcgtcaaaacgcggcggttctgaaggataaagcggatgtgagcctggctaagggtggcagcagctacgagagcctggaaagcctggttagctatattagcagcctg

SEQ ID NO: 4906 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKETRASSGVIWNSFKELEESELETVWQEIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4907 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcaggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcaggacgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaagatttcctggagattgcgcgtggtctggttgacagcaaacaaagctttctgtggcgggttcgtccgggctttgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4908 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQDAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4909 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcaggacgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggctctgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4910 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQDAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGSVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4911 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgattcgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcaggacgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggacgaggatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggctctgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgattttggtctcgatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4912 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDSQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQDAKEILDKMIKQTRASSGVIWNSFKELEESELETVWREIPAPSFLLPLPKHERASSSSLLDEDPSVFQWLDQQPPSSVLYVSFGTQSEVDEKDFLEIARGLVDSKQSFLWRVRPGSVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4913 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcaggacgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggctctgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcgagcctgaaggataaagcggatgtgagcctggctaagggtggcagcagctacgagagcctggaaagcctggttagctatattagcagcctg

SEQ ID NO: 4914 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQDAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGSVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAASLKDKADVSLAKGGSSYESLESLVSYISSL

SEQ ID NO: 4915 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtcagatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4916 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGQIENAIRRVMVDREGEVMRQNAAVLKDKADVSLAKGGSSYESLESLVSYISSL

SEQ ID NO: 4917 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaattttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4918 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPNFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4919 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcggtcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4920 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRSSPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4921 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattgtgcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4922 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIVQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4923 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattattcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4924 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIIQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4925 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtggagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4926 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVESVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4927 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattacgcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4928 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMITQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4929 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcgcgagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4930 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASASSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4931 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgaggttctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4932 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEVLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4933 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaacatgatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4934 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEHDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4935 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccggatagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4936 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPDSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4937 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggacagtgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4938 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDSDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4939 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttccggagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4940 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFPELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4941 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcatgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaagatgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4942 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWHEIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIEDAIRRVMVDREGEVMRQNAAVLKDKADVSLAKGGSSYESLESLVSYISSL

SEQ ID NO: 4943 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttgggctgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4944 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWAEIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4945 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattgggcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4946 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIGQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4947 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaaggctacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4948 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKATRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4949 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggacacggatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4950 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDTDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4951 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggtgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacctctctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4952 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWCIPIINEHGADEFRKELESLMRASPEDEEVACLITDALWYFAQPVADSLNLPRLVLMTSSLFNFHALVSLPQFLELGYLDPGDKTSLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4953 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgatgatacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4954 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDDTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4955 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgatccgacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4956 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDPTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4957 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaatcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4958 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMINQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4959 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggattatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4960 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWIIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4961 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgagggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4962 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGEGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4963 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagaagggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4964 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLEKGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4965 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgatttggcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtggattgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4966 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIWQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWIEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4967 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaatcggtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4968 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEESVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4969 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttgggaggaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4970 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWEEIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4971 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagtcggctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4972 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQSAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4973 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattttgcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4974 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMILQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4975 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgatgtgacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4976 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDVTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4977 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagacggctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4978 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQTAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4979 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaaaaggtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4980 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEKVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4981 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctcagggtggcagcagctacgagagcctggaaagcctggttagctatattagcagcctg

SEQ ID NO: 4982 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAQGGSSYESLESLVSYISSL

SEQ ID NO: 4983 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaaccggtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4984 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEPVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4985 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggagacgagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4986 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELETSELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4987 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttcgcttggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4988 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFAWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4989 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctgaatgaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4990 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLNEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4991 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattactcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4992 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAITRVMVDREGEVMRQNAAVLKDKADVSLAKGGSSYESLESLVSYISSL

SEQ ID NO: 4993 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtgaggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4994 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTREEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4995 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctgatggtggcagcagctacgagagcctggaaagcctggttagctatattagcagcctg

SEQ ID NO: 4996 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLADGGSSYESLESLVSYISSL

SEQ ID NO: 4997 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggactgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 4998 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWTEIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 4999 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgcgccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5000 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5001 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcaggaggctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5002 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQEAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5003 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggacaatgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5004 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDNDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5005 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattgagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5006 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIEQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5007 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcgaagctgaaggataaagcggatgtgagcctggctaagggtggcagcagctacgagagcctggaaagcctggttagctatattagcagcctg

SEQ ID NO: 5008 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5009 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgatgagacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5010 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDETRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5011 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggagaggagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5012 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELERSELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5013 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgttctgaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5014 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRSEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5015 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagccactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcgcgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5016 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNKPKTSHYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSALDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTLEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5017 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaaggaaacccgtgcgagcagcggtgtgatttggaacagctttaaagagctggaggaaagcgagctggaaaccgtttggcgtgaaattccggcgccgagcttcctgatgccgctgccgaagcacgagagggcgagcagcagcagcctgctggacggagatccgagcgtgttccagtggctggaccagcaaccgccgagcagcgtgctgtacgttagctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5018 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKETRASSGVIWNSFKELEESELETVWREIPAPSFLMPLPKHERASSSSLLDGDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5019 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacattaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaaggaaacccgtgcgagcagcggtgtgatttggaacagctttaaagagctggaggaaagcgagctggaaaccgtttggcgtgaaattccggcgccgagcttcctgctgccgctgccgaagcacatgagggcgagcagcagcagcctgctggaccacgatccgagcgtgttccagtggctggaccagcaaccgccgagcagcgtgctgtacgttagctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5020 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKETRASSGVIWNSFKELEESELETVWREIPAPSFLLPLPKHMRASSSSLLDHDPSVFQWLDQQPPSSVLYVSFGTQSEVDEKDFLEIARGLVDSKQSFLWRVRPGFVKGSEWVEPLPDGFLGERGRIVKSCPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5021 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacattaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcaggacgcttctgaaattctggataagatgattaaggaaacccgtgcgagcagcggtgtgatttggaacagctttaaagagctggaggaaagcgagctggaaaccgtttggcgtgaaattccggcgccgagcttcctgatgccgctgccgaagcactatagggcgagcagcagcagcctgctggaccacgatccgagcgtgttccagtggctggaccagcaaccgccgagcagcgtgctgtacgttagctttggcacccagagcgaggtggacgaaacagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgtaccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5022 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQDASEILDKMIKETRASSGVIWNSFKELEESELETVWREIPAPSFLMPLPKHYRASSSSLLDHDPSVFQWLDQQPPSSVLYVSFGTQSEVDETDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5023 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgctgccgctgccgaagcacataagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5024 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHIRASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5025 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaaggaaacccgtgcgagcagcggtgtgatttggaacagctttaaagagctggaggaaagcgagctggaaaccgtttggcgtgaaattccggcgccgagcttcctgctgccgctgccgaagcacataagggcgagcagcagcagcctgctggacggagatccgagcgtgttccagtggctggaccagcaaccgccgagcagcgtgctgtacgttagctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5026 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKETRASSGVIWNSFKELEESELETVWREIPAPSFLLPLPKHIRASSSSLLDGDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5027 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacattaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagatagcttctgaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgtaccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5028 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIASEILDKMIKETRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5029 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagatagctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccaaagcacgagagggcgagcagcagcagcctgctggacggagatccgagcgtgttccagtggctggaccagcaaccgccgagcagcgtgctgtacgttagctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5030 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKETRASSGVIWNSFKELEESELETVWREIPAPSFLLPLPKHERASSSSLLDGDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5031 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcaaacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggacggagatccgagcgtgttccagtggctggaccagcaaccgccgagcagcgtgctgtacgttggctttggcacccagagcgaggtggacgaaacagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5032 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDGDPSVFQWLDQQPPSSVLYVGFGTQSEVDETDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5033 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagatagctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccatgatccgagcgtgttccagtggctggaccagcaaccgccgagcagcgtgctgtacgttggctttggcacccagaccgaggtggacgaaacagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgtaccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5034 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVGFGTQTEVDETDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5035 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacattaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcaggacgctaaagaaattctggataagatgattaagcaaacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5036 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQDAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5037 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgtaccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5038 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKETRASSGVIWNSFKELEESELETVWREIPAPSFLLPLPKHERASSSSLLDHDPSVFQWLDQQPPSSVLYVGFGTQSEVDEKDFLEIARGLVDSKQSFLWRVRPGFVKGSEWVEPLPDGFLGERGRIVKSVPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5039 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacattaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcaaacccgtgcgagcagcggtgtgatttggaacagctttaaagagctggaggaaagcgagctggaaaccgtttggcgtgaaattccggcgccgagcttcctgctgccgctgccgaagcacgagagggcgagcagcagcagcctgctggaccacgatccgagcgtgttccagtggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgattttggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5040 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVGFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5041 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcaaacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggacggagatccgagcgtgttccagtggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgtaccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5042 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDGDPSVFQWLDQQPPSSVLYVGFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5043 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacattaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaaggaaacccgtgcgagcagcggtgtgatttggaacagctttaaagagctggaggaaagcgagctggaaaccgtttggcgtgaaattccggcgccgagcttcctgctgccgctgccgaagcactatagggcgagcagcagcagcctgctggaccacgatccgagcgtgttccagtggctggaccagcaaccgccgagcagcgtgctgtacgttggctttggcacccagaccgaggtggacgaaacagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5044 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKETRASSGVIWNSFKELEESELETVWREIPAPSFLLPLPKHYRASSSSLLDHDPSVFQWLDQQPPSSVLYVGFGTQTEVDETDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5045 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagatagctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaacagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5046 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKETRASSGVIWNSFKELEESELETVWREIPAPSFLLPLPKHERASSSSLLDHDPSVFQWLDQQPPSSVLYVSFGTQSEVDETDFLEIARGLVDSKQSFLWRVRPGFVKGSEWVEPLPDGFLGERGRIVKSVPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5047 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacattaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgtaccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5048 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5049 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacatgagggcgagcagcagcagcctgctggacggagatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5050 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHMRASSSSLLDGDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5051 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcacataagggcgagcagcagcagcctgctggacggagatccgagcgtgttccagtggctggaccagcaaccgccgagcagcgtgctgtacgttagctttggcacccagagcgaggtggacgaaacagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgtaccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5052 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKETRASSGVIWNSFKELEESELETVWREIPAPSFLLPLPKHIRASSSSLLDGDPSVFQWLDQQPPSSVLYVSFGTQSEVDETDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5053 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacattaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagatagctaaagaaattctggataagatgattaagcaaacccgtgcgagcagcggtgtgatttggaacagctttaaagagctggaggaaagcgagctggaaaccgtttggcgcgaaattccggcgccgagcttcctgctgccgctgccgaagcacgagagggcgagcagcagcagcctgctggaccacgatccgagcgtgttccagtggctggaccagcaaccgccgagcagcgtgctgtacgttagctttggcacccagagcgaggtggacgaaacagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5054 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDETDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5055 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttggctttggcacccagagcgaggtggacgaaacagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5056 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKETRASSGVIWNSFKELEESELETVWREIPAPSFLLPLPKHERASSSSLLDHDPSVFQWLDQQPPSSVLYVGFGTQSEVDETDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5057 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaagaaattctggataagatgattaaggaaacccgtgcgagcagcggtgtgatttggaacagctttaaagagctggaggaaagcgagctggaaaccgtttggcgtgaaattccggcgccgagcttcctgatgccgctgccgaagcactatagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgtaccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5058 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKETRASSGVIWNSFKELEESELETVWREIPAPSFLMPLPKHYRASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5059 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagatagcttctgaaattctggataagatgattaagcaaacccgtgcgagcagcggtgtgatttggaacagctttaaagagctggaggaaagcgagctggaaaccgtttggcgtgaaattccggcgccgagcttcctgatgccgctgccgaagcacatgagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5060 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIASEILDKMIKQTRASSGVIWNSFKELEESELETVWREIPAPSFLMPLPKHMRASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5061 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccatgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5062 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5063 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacattaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaaggaaacccgtgcgagcagcggtgtgatttggaacagctttaaagagctggaggaaagcgagctggaaaccgtttggcgtgaaattccggcgccgagcttcctgctgccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5064 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKETRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5065 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacggagatccgagcgtgttccagtggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5066 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKETRASSGVIWNSFKELEESELETVWREIPAPSFLLPLPKHYRASSSSLLDGDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5067 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagatagcttctgaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5068 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIASEILDKMIKETRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSCPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5069 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacattaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagatagctaaagaaattctggataagatgattaagcaaacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggacggagatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgtaccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5070 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDGDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5071 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccataacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaaggaaacccgtgcgagcagcggtgtgatttggaacagctttaaagagctggaggaaagcgagctggaaaccgtttggcgtgaaattccggcgccgagcttcctgatgccgctgccgaagcactatagggcgagcagcagcagcctgctggaccacgatccgagcgtgttccagtggctggaccagcaaccgccgagcagcgtgctgtacgttagctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgtaccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5072 - protein, 457 aa, Artificial Sequence
  "Variant of ADP-beta-1,3-glucosyltransferase"
MENKTETTVRRRRVILFPVPFPGHHNPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKETRASSGVIWNSFKELEESELETVWREIPAPSFLMPLPKHYRASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5073 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagatagctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5074 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKETRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5075 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcaggacgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5076 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQDAKEILDKMIKETRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5077 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacattaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagatagctaaagaaattctggataagatgattaagcaaacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5078 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSCPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5079 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcaaacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccatgatccgagcgtgttccagtggctggaccagcaaccgccgagcagcgtgctgtacgttagctttggcacccagagcgaggtggacgaaacagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5080 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDETDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5081 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcaaacccgtgcgagcagcggtgtgatttggaacagctttaaagagctggaggaaagcgagctggaaaccgtttggcgtgaaattccggcgccgagcttcctgctgccgctgccgaagcacgagagggcgagcagcagcagcctgctggaccatgatccgagcgtgttccagtggctggaccagcaaccgccgagcagcgtgctgtacgttggctttggcacccagaccgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5082 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVGFGTQTEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5083 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacattaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagatagctaaagaaattctggataagatgattaagcaaacccgtgcgagcagcggtgtgatttggaacagctttaaagagctggaggaaagcgagctggaaaccgtttggcgtgaaattccggcgccgagcttcctgctgccgctgccgaagcacgagagggcgagcagcagcagcctgctggaccacgatccgagcgtgttccagtggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5084 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5085 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacattaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcaggacgctaaagaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacatgagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5086 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQDAKEILDKMIKQTRASSGVIWNSFKELEESELETVWREIPAPSFLLPLPKHMRASSSSLLDHDPSVFQWLDQQPPSSVLYVSFGTQSEVDEKDFLEIARGLVDSKQSFLWRVRPGFVKGSEWVEPLPDGFLGERGRIVKSCPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5087 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaaggaaacccgtgcgagcagcggtgtgatttggaacagctttaaagagctggaggaaagcgagctggaaaccgtttggcgtgaaattccggcgccgagcttcctgatgccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5088 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKETRASSGVIWNSFKELEESELETVWREIPAPSFLMPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5089 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgcggaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5090 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPRTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5091 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggactgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5092 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWTVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5093 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagagtgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5094 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMESVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5095 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggtgtgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5096 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWCVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5097 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaccgagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5098 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKPSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5099 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5100 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWLVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5101 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaacctggctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5102 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTWLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5103 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgtgtaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagtctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5104 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPCTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5105 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgcttaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5106 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPLTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5107 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgtattctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5108 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVYSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5109 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgttgcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5110 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPLHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5111 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccggtgaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5112 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPVTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5113 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaagtggaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5114 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQVEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5115 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccggctcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5116 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPAHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5117 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccacgctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5118 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTTLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5119 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaacgtgtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5120 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQRVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5121 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgatgtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5122 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVMSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5123 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaagtgagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5124 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKVSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5125 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcgctatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5126 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESAMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5127 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgcagagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5128 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERAQSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5129 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcgggagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5130 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSGSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5131 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacacggcggttctgaaggataaagcggatgtgagcctggctaagggtggcagcagctacgagagcctggaaagcctggttagctatattagcagcctg

SEQ ID NO: 5132 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNTAVLKDKADVSLAKGGSSYESLESLVSYISSL

SEQ ID NO: 5133 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgatttcgcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5134 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAISRVMVDREGEVMRQNAAVLKDKADVSLAKGGSSYESLESLVSYISSL

SEQ ID NO: 5135 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcggagagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5136 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERAESSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5137 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5138 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLHVGVYLENGLERGEIENAIRRVMVDREGEVMRQNAAVLKDKADVSLAKGGSSYESLESLVSYISSL

SEQ ID NO: 5139 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatcagaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5140 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYQNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5141 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacattctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5142 - protein, 457 aa, Artificial Sequence
  "Variant of ADP-beta-1,3-glucosyltransferase"
MENKTETTVRRRRVILFPVPFPGHINPMLQLANILYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5143 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcacgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5144 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESTMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5145 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcggtagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5146 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASGSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5147 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagctgtatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5148 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESCMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5149 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagatgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5150 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEMLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5151 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgcaggtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5152 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLQVGVYLENGLERGEIENAIRRVMVDREGEVMRQNAAVLKDKADVSLAKGGSSYESLESLVSYISSL

SEQ ID NO: 5153 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtgcgctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5154 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARALVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5155 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggtctgctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5156 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGLLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5157 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcagttttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5158 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFSFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5159 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtatggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5160 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRMEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5161 - DNA, 1371 bp, Artificial Sequence
  "Variant of ADP-beta-1,3-glucosyltransferase"
atggagaacaaaaccgaaaccgatgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5162 - protein, 457 aa, Artificial Sequence
  "Variant of ADP-beta-1,3-glucosyltransferase"
MENKTETDVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5163 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattgagcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5164 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIERVMVDREGEVMRQNAAVLKDKADVSLAKGGSSYESLESLVSYISSL

SEQ ID NO: 5165 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgcttgttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5166 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVLVDREGEVMRQNAAVLKDKADVSLAKGGSSYESLESLVSYISSL

SEQ ID NO: 5167 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtacggtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5168 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRTVMVDREGEVMRQNAAVLKDKADVSLAKGGSSYESLESLVSYISSL

SEQ ID NO: 5169 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatggtggatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5170 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMVDVLKVGVYLENGLERGEIENAIRRVMVDREGEVMRQNAAVLKDKADVSLAKGGSSYESLESLVSYISSL

SEQ ID NO: 5171 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagacgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5172 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVETLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5173 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcggggccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5174 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRAGPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5175 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagtttctggaaagcctggttagctatattagcagcctg

SEQ ID NO: 5176 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYEFLESLVSYISSL

SEQ ID NO: 5177 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggatactgcggatgtgagcctggctaagggtggcagcagctacgagagcctggaaagcctggttagctatattagcagcctg

SEQ ID NO: 5178 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDTADVSLAKGGSSYESLESLVSYISSL

SEQ ID NO: 5179 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagccctagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5180 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASPSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5181 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtatggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggcctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5182 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRMVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5183 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgcgtgataaagcggatgtgagcctggctaagggtggcagcagctacgagagcctggaaagcctggttagctatattagcagcctg

SEQ ID NO: 5184 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLRDKADVSLAKGGSSYESLESLVSYISSL

SEQ ID NO: 5185 - DNA, 1371 bp, Artificial Sequence
  "Variant of ADP-beta-1,3-glucosyltransferase"
atggagaacaaaaccgaaaccaccggtcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5186 - protein, 457 aa, Artificial Sequence
  "Variant of ADP-beta-1,3-glucosyltransferase"
MENKTETTGRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5187 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcatgagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5188 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSMSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5189 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcggcgagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5190 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERAASSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5191 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagcgtctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5192 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVERLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5193 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccgaagccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5194 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPKPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5195 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgatccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5196 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVDPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5197 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcgatctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5198 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSDLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5199 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcacgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5200 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSTLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5201 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgtgtcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5202 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLCRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5203 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgtgtccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5204 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRACPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5205 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagctggctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5206 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSWLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5207 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcatgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtgctctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5208 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWHEIPAPSFLLPLPKHERASSSSLLDHDPSVFQWLDQQPPSSVLYVSFGTQSEVDEKDFLEIARALVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5209 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagccctagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5210 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSPSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5211 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaacttctggttagctatattagcagcctg

SEQ ID NO: 5212 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLELLVSYISSL

SEQ ID NO: 5213 - DNA, 1371 bp, Artificial Sequence
  "Variant of ADP-beta-1,3-glucosyltransferase"
atggagaacaaaaccgaaaccctggtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5214 - protein, 457 aa, Artificial Sequence
  "Variant of ADP-beta-1,3-glucosyltransferase"
MENKTETLVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5215 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcatgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5216 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRHVMVDREGEVMRQNAAVLKDKADVSLAKGGSSYESLESLVSYISSL

SEQ ID NO: 5217 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgacggatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5218 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMTDVLKVGVYLENGLERGEIENAIRRVMVDREGEVMRQNAAVLKDKADVSLAKGGSSYESLESLVSYISSL

SEQ ID NO: 5219 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaactctccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5220 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNSPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5221 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgagtacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5222 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLSTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5223 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaagactattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgttggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5224 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKTILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5225 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgcggattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5226 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPRINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5227 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgataagcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5228 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDKQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5229 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacacgccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5230 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNTPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5231 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggtcgtcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5232 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGRRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5233 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgactattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5234 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPTINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5235 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctggtgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5236 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLVTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5237 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacaatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5238 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNNPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5239 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgcagcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5240 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLQQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5241 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgcagattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5242 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPQINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5243 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggtatgcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5244 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGMRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5245 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggactcttggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5246 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDSWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5247 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaggcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5248 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIRRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5249 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacagtctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5250 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHSLVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5251 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaagcctattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5252 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKPILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5253 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgggtacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5254 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLGTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5255 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgttgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggtctgcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5256 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGLRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5257 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaaccagccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5258 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNQPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5259 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggatccgatgattaagcagacccgtgcgagcagcggtgtgatttggaacagctttaaagagctggaggaaagcgagctggaaaccgtttggcgtgaaattccggcgccgagcttcctgcttccgctgccgaagcacgagagggcgagcagcagcagcctgctggaccacgatccgagcgtgttccagtggctggaccagcaaccgccgagcagcgtgctgtacgttagctttggcacccagagcgaggtggacgaaaaggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccatggagggcgtggtggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5260 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDPMIKQTRASSGVIWNSFKELEESELETVWREIPAPSFLLPLPKHERASSSSLLDHDPSVFQWLDQQPPSSVLYVSFGTQSEVDEKDFLEIARGLVDSKQSFLWRVRPGFVKGSEWVEPLPDGFLGERGRIVKSVPQQEVLAHDAIGAFWTHGGWNGTMEGVVEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5261 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggagaatcccgatcattaacgagcacggcgcggatgaattccgtaaagagctggaaagcctgatgcgggctagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcaggaggctaaagaaattctggataagatgattaaggaaacccgtgcgagcagcggtgtgatttggaacagctttaaggagctggaggaaagcgagctggaaaccgtttggagggaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5262 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQEAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5263 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggagaatcccgatcattaacgagcacggcgcggatgaattccgtaaagagctggaaagcctgatgcgggctagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcaagaaattccggcgccgagcttcctgcttccgctgccgaagcactatagggcgagcagcagcagcctgctggacggagatccgagcgtgttccagtggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5264 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQDAKEILDKMIKETRASSGVIWNSFKELEESELETVWQEIPAPSFLLPLPKHYRASSSSLLDGDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5265 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattacgcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5266 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPNFLELGYLDPGDKTRLEEQVVGFPMLKVKDIKRAYSNWQIAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAITRVMVDREGEVMRQNAAVLKDKADVSLAKGGSSYESLESLVSYISSL

SEQ ID NO: 5267 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaggagctggaggaaagcgagctggaaaccgtttggcgtgaaattccggcgccgagcttcctgcttccgctgccgaagcactatagggcgagcagcagcagcctgctggacggagatccgagcgtgttccagtggctggaccagcaaccgccgagcagcgtgctgtacgttggctttggcacccagagcgaggtggacgaaaaagatttcctggagattgcgcgtggtctggttgacagcaaacaaagctttctgtggcgggtccgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5268 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRASPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDGDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5269 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5270 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5271 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaaggaaacccgtgcgagcagcggtgtgatttggaacagctttaaggagctggaggaaagcgagctggaaaccgtttggacggaaattccggcgccgagcttcctgcttccgctgccgaagcactatagggcgagcagcagcagcctgctggacggagatccgagcgtgttccagtggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5272 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKETRASSGVIWNSFKELEESELETVWTEIPAPSFLLPLPKHYRASSSSLLDGDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5273 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggagaatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggagggaaattccggcgccgagcttcctgcttccgctgccgaagcactatagggcgagcagcagcagcctgctggacggagatccgagcgtgttccagtggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5274 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQDAKEILDKMIKETRASSGVIWNSFKELEESELETVWREIPAPSFLLPLPKHYRASSSSLLDGDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5275 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggagaatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcaggaggcttccgaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacggagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5276 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQEASEILDKMIKETRASSGVIWNSFKELEESELETVWREIPAPSFLLPLPKHYRASSSSLLDGDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5277 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaaggaaacccgtgcgagcagcggtgtgatttggaacagctttaaagagctggaggaaagcgagctggaaaccgtttggagggaaattccggcgccgagcttcctgcttccgctgccgaagcactatagggcgagcagcagcagcctgctggacggagatccgagcgtgttccagtggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5278 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKETRASSGVIWNSFKELEESELETVWREIPAPSFLLPLPKHYRASSSSLLDGDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5279 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggctagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggagggaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5280 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5281 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggctagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaacaagtggtaggtttcccgatgctgaaggttaaagatatcaagcgcgcgtatagcaattggcaggatgcttccgaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5282 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQDASEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5283 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaaggaaacccgtgcgagcagcggtgtgatttggaacagctttaaagagctggaggaaagcgagctggaaaccgtttggagggaaattccggcgccgagcttcctgcttccgctgccgaagcactatagggcgagcagcagcagcctgctggacggagatccgagcgtgttccagtggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5284 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKETRASSGVIWNSFKELEESELETVWREIPAPSFLLPLPKHYRASSSSLLDGDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5285 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacaatgatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5286 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKETRASSGVIWNSFKELEESELETVWREIPAPSFLLPLPKHYRASSSSLLDNDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5287 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggacggaaattccggcgccgagcttcctgcttccgctgccgaagcactatagggcgagcagcagcagcctgctggacaatgatccgagcgtgttcgcctggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5288 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWTEIPAPSFLLPLPKHYRASSSSLLDNDPSVFAWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5289 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5290 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5291 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttcgcctggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5292 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKETRASSGVIWNSFKELEESELETVWREIPAPSFLLPLPKHYRASSSSLLDEDPSVFAWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5293 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggagaatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggaggctaaagaaattctggataagatgattaaggaaacccgtgcgagcagcggtgtgatttggaacagctttaaagagctggaggaaagcgagctggaaaccgtttggagggaaattccggcgccgagcttcctgcttccgctgccgaagcactatagggcgagcagcagcagcctgctggacggagatccgagcgtgttccagtggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattacgcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5294 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPNFLELGYLDPGDKTRLEEQVVGFPMLKVKDIKRAYSNWQEAKEILDKMIKETRASSGVIWNSFKELEESELETVWREIPAPSFLLPLPKHYRASSSSLLDGDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAITRVMVDREGEVMRQNAAVLKDKADVSLAKGGSSYESLESLVSYISSL

SEQ ID NO: 5295 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggagaatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacaatgatccgagcgtgttcgcctggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattacgcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5296 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRDSPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKETRASSGVIWNSFKELEESELETVWREIPAPSFLLPLPKHYRASSSSLLDNDPSVFAWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAITRVMVDREGEVMRQNAAVLKDKADVSLAKGGSSYESLESLVSYISSL

SEQ ID NO: 5297 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggaggcttccgaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacggagatccgagcgtgttccagtggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5298 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQEASEILDKMIKETRASSGVIWNSFKELEESELETVWREIPAPSFLLPLPKHYRASSSSLLDGDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5299 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagagcgctaaagaaattctggataagatgattaaggaaacccgtgcgagcagcggtgtgatttggaacagctttaaggagctggaggaaagcgagctggaaaccgtttggcgtgaaattccggcgccgagcttcctgcttccgctgccgaagcactatagggcgagcagcagcagcctgctggacggagatccgagcgtgttccagtggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5300 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPQFLELGYLDPGDKTRLEEQVVGFPMLKVKDIKRAYSNWQSAKEILDKMIKETRASSGVIWNSFKELEESELETVWREIPAPSFLLPLPKHYRASSSSLLDGDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5301 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacggagatccgagcgtgttccagtggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5302 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPQFLELGYLDPGDKTRLEEQVVGFPMLKVKDIKRAYSNWQDAKEILDKMIKETRASSGVIWNSFKELEESELETVWREIPAPSFLLPLPKHYRASSSSLLDGDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5303 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggagaatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaaggaaacccgtgcgagcagcggtgtgatttggaacagctttaaagagctggaggaaagcgagctggaaaccgtttgggaagaaattccggcgccgagcttcctgcttccgctgccgaagcactatagggcgagcagcagcagcctgctggacggagatccgagcgtgttccagtggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5304 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKETRASSGVIWNSFKELEESELETVWEEIPAPSFLLPLPKHYRASSSSLLDGDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5305 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagagcgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacggagatccgagcgtgttccagtggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5306 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQSAKEILDKMIKETRASSGVIWNSFKELEESELETVWREIPAPSFLLPLPKHYRASSSSLLDGDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5307 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggagaatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcaggatgcttccgaaattctggataagatgattaaggaaacccgtgcgagcagcggtgtgatttggaacagctttaaagagctggaggaaagcgagctggaaaccgtttgggaagaaattccggcgccgagcttcctgcttccgctgccgaagcactatagggcgagcagcagcagcctgctggacggagatccgagcgtgttccagtggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5308 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQDASEILDKMIKETRASSGVIWNSFKELEESELETVWEEIPAPSFLLPLPKHYRASSSSLLDGDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5309 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacggagatccgagcgtgttccagtggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5310 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKETRASSGVIWNSFKELEESELETVWREIPAPSFLLPLPKHYRASSSSLLDGDPSVFQWLDQQPPSSVLYVGFGTQSEVDEKDFLEIARGLVDSKQSFLWRVRPGFVKGSEWIEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5311 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattgaggaaacccgtgcgagcagcggtgtgatttggaacagctttaaagagctggaggagagcgagctggaaaccgtttggcgtgaaattccggcgccgagcttcctgcttccgctgccgaagcactatagggcgagcagcagcagcctgctggacggagatccgagcgtgttccagtggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5312 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIEETRASSGVIWNSFKELEESELETVWREIPAPSFLLPLPKHYRASSSSLLDGDPSVFQWLDQQPPSSVLYVGFGTQSEVDEKDFLEIARGLVDSKQSFLWRVRPGFVKGSEWIEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5313 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgatgagacccgtcttgaggaacaagtggtaggtttcccgatgctgaaggttaaagatatcaagcgcgcgtatagcaattggcagattgctaaggaaattctggataagatgattgaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacggagatccgagcgtgttccagtggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5314 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDETRLEEQVVGFPMLKVKDIKRAYSNWQIAKEILDKMIEETRASSGVIWNSFKELEESELETVWREIPAPSFLLPLPKHYRASSSSLLDGDPSVFQWLDQQPPSSVLYVGFGTQSEVDEKDFLEIARGLVDSKQSFLWRVRPGFVKGSEWIEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5315 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgatccaacccgtcttgaggaacctgtggtaggtttcccgatgctgaaggttaaagatatcaagcgcgcgtatagcaattggcagattgctaaggaaattctggataagatgattaaggaaacccgtgcgagcagcggtgtgatttggaacagctttaaagagctggaggagagcgagctggaaaccgtttggcgtgaaattccggcgccgagcttcctgcttccgctgccgaagcactatagggcgagcagcagcagcctgctggacggagatccgagcgtgttccagtggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5316 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDPTRLEEPVVGFPMLKVKDIKRAYSNWQIAKEILDKMIKETRASSGVIWNSFKELEESELETVWREIPAPSFLLPLPKHYRASSSSLLDGDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5317 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataagacccgtgaggaggaacaagtggtaggtttcccgatgctgaaggttaaagatatcaagcgcgcgtatagcaattggcagattgctaaggaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacggagatccgagcgtgttccagtggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5318 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTREEEQVVGFPMLKVKDIKRAYSNWQIAKEILDKMIKETRASSGVIWNSFKELEESELETVWREIPAPSFLLPLPKHYRASSSSLLDGDPSVFQWLDQQPPSSVLYVGFGTQSEVDEKDFLEIARGLVDSKQSFLWRVRPGFVKGSEWIEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5319 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgatccaacccgtgagaacgaacctgtggtaggtttcccgatgctgaaggttaaagatatcaagcgcgcgtatagcaattggcagattgctaaggaaattctggataagatgatttgggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacggagatccgagcgtgttccagtggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcgaaactgaaggataaagcggatgtgagcctggctgatggtggcagcagctacgagagcctggaaagcctggttagctatattagcagcctg

SEQ ID NO: 5320 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDPTRENEPVVGFPMLKVKDIKRAYSNWQIAKEILDKMIWETRASSGVIWNSFKELEESELETVWREIPAPSFLLPLPKHYRASSSSLLDGDPSVFQWLDQQPPSSVLYVGFGTQSEVDEKDFLEIARGLVDSKQSFLWRVRPGFVKGSEWIEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLADGGSSYESLESLVSYISSL

SEQ ID NO: 5321 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacggagatccgagcgtgttccagtggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcgaaactgaaggataaagcggatgtgagcctggctaagggtggcagcagctacgagagcctggaaagcctggtcagctatattagcagcctg

SEQ ID NO: 5322 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKETRASSGVIWNSFKELEESELETVWREIPAPSFLLPLPKHYRASSSSLLDGDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5323 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattaaggaaacccgtgcgagcagcggtgtgatttggaacagctttaaagagctggaggagagcgagctggaaaccgtttggcgtgaaattccggcgccgagcttcctgcttccgctgccgaagcactatagggcgagcagcagcagcctgctggacggagatccgagcgtgttccagtggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5324 - protein, 457 aa, Artificial Sequence; identical to SEQ ID NO: 5310
  "Variant of ADP-beta-1,3-glucosyltransferase"

SEQ ID NO: 5325 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataagacccgtgagaacgaacctgtggtaggtttcccgatgctgaaggttaaagatatcaagcgcgcgtatagcaattggcagattgctaaggaaattctggataagatgattgaggaaacccgtgcgagcagcggtgtgatttggaacagctttaaagagctggaggagagcgagctggaaaccgtttggcgtgaaattccggcgccgagcttcctgcttccgctgccgaagcactatagggcgagcagcagcagcctgctggacggagatccgagcgtgttccagtggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5326 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRENEPVVGFPMLKVKDIKRAYSNWQIAKEILDKMIEETRASSGVIWNSFKELEESELETVWREIPAPSFLLPLPKHYRASSSSLLDGDPSVFQWLDQQPPSSVLYVGFGTQSEVDEKDFLEIARGLVDSKQSFLWRVRPGFVKGSEWIEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5327 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgatgagacccgtcttgaggaacaagtggtaggtttcccgatgctgaaggttaaagatatcaagcgcgcgtatagcaattggcagattgctaaggaaattctggataagatgattgaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacggagatccgagcgtgttccagtggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5328 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDETRLEEQVVGFPMLKVKDIKRAYSNWQIAKEILDKMIEETRASSGVIWNSFKELEESELETVWREIPAPSFLLPLPKHYRASSSSLLDGDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5329 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgatgagacccgtcttgaggaacctgtggtaggtttcccgatgctgaaggttaaagatatcaagcgcgcgtatagcaattggcagattgctaaggaaattctggataagatgattaaggaaacccgtgcgagcagcggtgtgatttggaacagctttaaagagctggagacgagcgagctggaaaccgtttggcgtgaaattccggcgccgagcttcctgcttccgctgccgaagcactatagggcgagcagcagcagcctgctggacggagatccgagcgtgttccagtggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcgaaactgaaggataaagcggatgtgagcctggctgatggtggcagcagctacgagagcctggaaagcctggttagctatattagcagcctg

SEQ ID NO: 5330 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDETRLEEPVVGFPMLKVKDIKRAYSNWQIAKEILDKMIKETRASSGVIWNSFKELETSELETVWREIPAPSFLLPLPKHYRASSSSLLDGDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLADGGSSYESLESLVSYISSL

SEQ ID NO: 5331 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgatccaacccgtcttaacgaacctgtggtaggtttcccgatgctgaaggttaaagatatcaagcgcgcgtatagcaattggcagattgctaaggaaattctggataagatgattttggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacggagatccgagcgtgttccagtggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5332 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDPTRLNEPVVGFPMLKVKDIKRAYSNWQIAKEILDKMILETRASSGVIWNSFKELEESELETVWREIPAPSFLLPLPKHYRASSSSLLDGDPSVFQWLDQQPPSSVLYVGFGTQSEVDEKDFLEIARGLVDSKQSFLWRVRPGFVKGSEWIEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5333 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattgaggaaacccgtgcgagcagcggtgtgatttggaacagctttaaagagctggaggagagcgagctggaaaccgtttggcgtgaaattccggcgccgagcttcctgcttccgctgccgaagcactatagggcgagcagcagcagcctgctggacggagatccgagcgtgttccagtggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5334 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIEETRASSGVIWNSFKELEESELETVWREIPAPSFLLPLPKHYRASSSSLLDGDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5335 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgatgagacccgtcttgaggaacaagtggtaggtttcccgatgctgaaggttaaagatatcaagcgcgcgtatagcaattggcagattgctaaggaaattctggataagatgattgaggaaacccgtgcgagcagcggtgtgatttggaacagctttaaagagctggaggagagcgagctggaaaccgtttggcgtgaaattccggcgccgagcttcctgcttccgctgccgaagcactatagggcgagcagcagcagcctgctggacggagatccgagcgtgttccagtggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5336 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDETRLEEQVVGFPMLKVKDIKRAYSNWQIAKEILDKMIEETRASSGVIWNSFKELEESELETVWREIPAPSFLLPLPKHYRASSSSLLDGDPSVFQWLDQQPPSSVLYVGFGTQSEVDEKDFLEIARGLVDSKQSFLWRVRPGFVKGSEWIEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5337 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataagacccgtgagaacgaacaagtggtaggtttcccgatgctgaaggttaaagatatcaagcgcgcgtatagcaattggcagattgctaaggaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacggagatccgagcgtgttccagtggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5338 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRENEQVVGFPMLKVKDIKRAYSNWQIAKEILDKMIKETRASSGVIWNSFKELEESELETVWREIPAPSFLLPLPKHYRASSSSLLDGDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5339 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattgaggaaacccgtgcgagcagcggtgtgatttggaacagctttaaagagctggaggagagcgagctggaaaccgtttggcgtgaaattccggcgccgagcttcctgcttccgctgccgaagcactatagggcgagcagcagcagcctgctggacggagatccgagcgtgttccagtggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5340 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIEETRASSGVIWNSFKELEESELETVWREIPAPSFLLPLPKHYRASSSSLLDGDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5341 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgctaaggaaattctggataagatgattttggaaacccgtgcgagcagcggtgtgatttggaacagctttaaagagctggaggagagcgagctggaaaccgtttggcgtgaaattccggcgccgagcttcctgcttccgctgccgaagcactatagggcgagcagcagcagcctgctggacggagatccgagcgtgttccagtggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggcgaatgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcgtcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5342 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMILETRASSGVIWNSFKELEESELETVWREIPAPSFLLPLPKHYRASSSSLLDGDPSVFQWLDQQPPSSVLYVGFGTQSEVDEKDFLEIARGLVDSKQSFLWRVRPGFVKGSEWIEPLPDGFLGECGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5343 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaagacgagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5344 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWLVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5345 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgagggtgaccctttatccgcacttcacctttcgttttatcttggacaacgatccgcaggacgaatggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccactcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaagccgattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5346 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPRVTLYPHFTFRFILDNDPQDEWLRNLPTHGPGAGWIIPIINEHGADEFRKELESLMRDSPEDEEVACLITDALWYFAQPVADSLNLPRLVLMTSSLFNFHSLVSLPNFLELGYLDPGDKTRLEEQVVGFPMLKVKDIKRAYSNWQDAKPILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5347 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggtatgataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5348 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGMIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5349 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccggtcacgagcctttatccgcacttcacctttcgttttatcttggacaacgatccgcaggacgaatggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgatcctacccgtctggaggaacaagtggtaggtttcccgatgctgaaggttaaagatatcaagcgcgcgtatagcaattggcaggatgctaaggaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaaaggtggcagcagctacgagagcctggaaagcctggttagctatattagcagcctg

SEQ ID NO: 5350 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPVTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDPTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWLVRPGFVKGSEWVEPLPDGFLGERGRIVKSCPQQEVLAHDAIGAFWTHGGWNGTMEGVAEGVPMIFSDFGLDQPLNARYMSDVLHVGVYLENGLERGEIENAIRRVMVDREGEVMRQNAAVLKDKADVSLAKGGSSYESLESLVSYISSL

SEQ ID NO: 5351 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaagacgagcctttatccgcacttcacctttcgttttatcttggacaacgatccgcaggacgagtggcttcgcaacctgccgacccatggtccgggcgcgggttggataatcccgaccattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaagccgattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctgatggtggcagcagccacgagagcctggaaagcctggttagctatattagcagcctg

SEQ ID NO: 5352 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPTINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKPILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLADGGSSHESLESLVSYISSL

SEQ ID NO: 5353 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaggaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggctggttcgtccgggcttcgtgaagggtagcgagtgggttgagccgctgccggatggtttactgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctgatggtggcagcagctacgagagcctggaaagcctggttagctatattagcagcctg

SEQ ID NO: 5354 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWLVRPGFVKGSEWVEPLPDGLLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLADGGSSYESLESLVSYISSL

SEQ ID NO: 5355 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaagacgagcctttatccgcacttcacctttcgttttatcttggacaacgatccgcaggactcgtggcttcgcaacctgccgacccatggtccgggcgcgggtatgataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaagccgattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaaaggtggcagcagctacgagagcctggaaagcctggttagctatattagcagcctg

SEQ ID NO: 5356 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDSWLRNLPTHGPGAGMIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKPILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5357 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccggtcgtgagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5358 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPVVSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWLVRPGFVKGSEWVEPLPDGFLGERGRIVKSCPQQEVLAHDAIGAFWTHGGWNGTMEGVAEGVPMIFSDFGLDQPLNARYMSDVLHVGVYLENGLERGEIENAIRRVMVDREGEVMRQNAAVLKDKADVSLAKGGSSYESLESLVSYISSL

SEQ ID NO: 5359 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacattaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccggctcacattagggcggaaagcatgagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5360 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPAHIRAESMSLLDEDPSVFQWLDQQPPSSVLYVGFGTQSEVDEKDFLEIARGLVDSKQSFLWRVRPGFVKGSEWIEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5361 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaagaaacccgtgcgagcagcggtgtgatttggaacagctttaaagagctggaggaaagcgagctggaaaccgtttggcgtgaaattccggcgccgagcttcctgcttccgctgccgttacacattagggcggaaagctcaagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagagcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5362 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPLHIRAESSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMESVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5363 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacattaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5364 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5365 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacattaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgtcgggctcaagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5366 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASGSSLLDEDPSVFQWLDQQPPSSVLYVGFGTQSEVDEKDFLEIARGLVDSKQSFLWRVRPGFVKGSEWIEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5367 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcacattagggcggaaggcatgagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5368 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHIRAEGMSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5369 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacattaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcggaaggcatgagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5370 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRAEGMSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5371 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5372 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5373 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcagacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5374 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIRRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5375 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacattaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgatttgggaaacccgtgcgagcagcggtgtgatttggaacagctttaaagagctggaggaaagcgagctggaaaccgtttggcgtgaaattccggcgccgagcttcctgcttccgctgccgaagcactatagggcggaaagcatgagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5376 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIWETRASSGVIWNSFKELEESELETVWREIPAPSFLLPLPKHYRAESMSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5377 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacattaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcgcaatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccggctcacattagggcggaaagcatgagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagagcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5378 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESAMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPAHIRAESMSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMESVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5379 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacattaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcgcaatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaatgaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagagcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5380 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESAMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMINETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWIEPLPDGFLGERGRIVKSCPQQEVLAHDAIGAFWTHGGWNGTMESVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5381 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcgcaatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5382 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESAMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5383 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacattaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcagacgcgcgtatagcaattggcaggatgctaaagaaattctggataagatgattaatgaaacccgtgcgagcagcggtgtgatttggaacagctttaaagagctggaggaaagcgagctggaaaccgtttggcgtgaaattccggcgccgagcttcctgcttccgctgccgttacactatagggcggaaagctcaagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5384 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIRRAYSNWQDAKEILDKMINETRASSGVIWNSFKELEESELETVWREIPAPSFLLPLPLHYRAESSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5385 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgtttggcgtgaaattccggcgccgagcttcctgcttccgctgccgttacactatagggcggaaggctcaagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagagcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5386 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIEETRASSGVIWNSFKELEESELETVWREIPAPSFLLPLPLHYRAEGSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMESVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5387 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacattaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgtcgagctcaagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5388 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWIEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5389 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacattaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5390 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWIEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5391 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaatgaaacccgtgcgagcagcggtgtgatttggaacagctttaaagagctggaggaaagcgagctggaaaccgtttggcgtgaaattccggcgccgagcttcctgcttccgctgccgaagcactatagggcggaaggctcaagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggtgctgaaggataaagcggatgtgagcctggctaagggtggcagcagctacgagagcctggaaagcctggttagctatattagcagcctg

SEQ ID NO: 5392 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMINETRASSGVIWNSFKELEESELETVWREIPAPSFLLPLPKHYRAEGSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5393 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacattaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcgcaatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccggctcactatagggcggaaagctcaagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5394 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESAMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPAHYRAESSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5395 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacattaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagcacaatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaatgaaacccgtgcgagcagcggtgtgatttggaacagctttaaagagctggaggaaagcgagctggaaaccgtttggcgtgaaattccggcgccgagcttcctgcttccgctgccgaagcactatagggcggaaggcatgagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagagcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5396 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFSFRFILDNDPQDEWLRNLPTHGPGAGWIIPIINEHGADEFRKELESTMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMINETRASSGVIWNSFKELEESELETVWREIPAPSFLLPLPKHYRAEGMSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMESVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5397 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcacaatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgtcgagctcaagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5398 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFTFRFILDNDPQDEWLRNLPTHGPGAGWIIPIINEHGADEFRKELESTMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIEETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWIEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5399 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacattaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagagcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5400 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWIEPLPDGFLGERGRIVKSCPQQEVLAHDAIGAFWTHGGWNGTMESVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5401 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacattaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcgcaatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccggctcactatagggcgtcgagctcaagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5402 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESAMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPAHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5403 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacattaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcacattagggcggaaagcatgagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5404 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHIRAESMSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5405 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatcagagcctggctaagggtggcagcagctacgagagcctggaaagcctggttagctatattagcagcctg

SEQ ID NO: 5406 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADQSLAKGGSSYESLESLVSYISSL

SEQ ID NO: 5407 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaacatcgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5408 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKHRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5409 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatcggagcctggctaagggtggcagcagctacgagagcctggaaagcctggttagctatattagcagcctg

SEQ ID NO: 5410 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADRSLAKGGSSYESLESLVSYISSL

SEQ ID NO: 5411 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcgcttgttctgaaggataaagcggatgtgagcctggctaagggtggcagcagctacgagagcctggaaagcctggttagctatattagcagcctg

SEQ ID NO: 5412 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNALVLKDKADVSLAKGGSSYESLESLVSYISSL

SEQ ID NO: 5413 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcatggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5414 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIAHGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5415 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaatcggatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5416 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDESDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5417 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacctgtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5418 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEPVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5419 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtactgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5420 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERTEIENAIRRVMVDREGEVMRQNAAVLKDKADVSLAKGGSSYESLESLVSYISSL

SEQ ID NO: 5421 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctgcagaagggtggcagcagctacgagagcctggaaagcctggttagctatattagcagcctg

SEQ ID NO: 5422 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLQKGGSSYESLESLVSYISSL

SEQ ID NO: 5423 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggagaaagcggatgtgagcctggctaagggtggcagcagctacgagagcctggaaagcctggttagctatattagcagcctg

SEQ ID NO: 5424 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKEKADVSLAKGGSSYESLESLVSYISSL

SEQ ID NO: 5425 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggagctgaaggataaagcgaatgtgagcctggctaagggtggcagcagctacgagagcctggaaagcctggttagctatattagcagcctg

SEQ ID NO: 5426 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAELKDKANVSLAKGGSSYESLESLVSYISSL

SEQ ID NO: 5427 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaagctagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5428 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKASLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5429 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgatacgacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5430 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDTTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5431 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgttcagcgtgaaattccggcgccgagcttcctgcttccgctgccgaagcactatagggcgagcagcagcagcctgctggacgaagatccgagcgtgttccaatggctggaccggcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5432 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVQREIPAPSFLLPLPKHYRASSSSLLDEDPSVFQWLDRQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5433 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaagcgtaaagcggatgtgagcctggctaagggtggcagcagctacgagagcctggaaagcctggttagctatattagcagcctg

SEQ ID NO: 5434 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKRKADVSLAKGGSSYESLESLVSYISSL

SEQ ID NO: 5435 - DNA, 1371 bp, Artificial Sequence
  "Variant of ADP-beta-1,3-glucosyltransferase"
atgcttaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5436 - protein, 457 aa, Artificial Sequence
  "Variant of ADP-beta-1,3-glucosyltransferase"
MLNKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5437 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5438 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5439 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgttggaacgcggcggttctgaaggataaagcggatgtgagcctggctaagggtggcagcagctacgagagcctggaaagcctggttagctatattagcagcctg

SEQ ID NO: 5440 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRWNAAVLKDKADVSLAKGGSSYESLESLVSYISSL

SEQ ID NO: 5441 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaacgctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5442 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELETLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5443 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgcttgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5444 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPLDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5445 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgttcagcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5446 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVQREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5447 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccctgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5448 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDPEGEVMRQNAAVLKDKADVSLAKGGSSYESLESLVSYISSL

SEQ ID NO: 5449 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgtgtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5450 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPCDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5451 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggcgggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5452 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVAGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5453 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtcgtgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5454 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGREWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5455 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgattctgaaggataaagcggatgtgagcctggctaagggtggcagcagctacgagagcctggaaagcctggttagctatattagcagcctg

SEQ ID NO: 5456 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAILKDKADVSLAKGGSSYESLESLVSYISSL

SEQ ID NO: 5457 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgttatgcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5458 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVMREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5459 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactataggcttagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5460 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRLSSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5461 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggataagagcctggctaagggtggcagcagctacgagagcctggaaagcctggttagctatattagcagcctg

SEQ ID NO: 5462 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADKSLAKGGSSYESLESLVSYISSL

SEQ ID NO: 5463 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaacgggcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5464 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIERAIRRVMVDREGEVMRQNAAVLKDKADVSLAKGGSSYESLESLVSYISSL

SEQ ID NO: 5465 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttgtcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5466 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVCREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5467 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccacacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcaccatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5468 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHHAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5469 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgattcgacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5470 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDSTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5471 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcagggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5472 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIAQGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5473 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagcttcaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgggagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5474 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVGSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5475 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccggtggataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5476 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPVDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5477 - DNA, 1371 bp, Artificial Sequence
  "Variant of ADP-beta-1,3-glucosyltransferase"
atgaataacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5478 - protein, 457 aa, Artificial Sequence
  "Variant of ADP-beta-1,3-glucosyltransferase"
MNNKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5479 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatatgagcctggctaagggtggcagcagctacgagagcctggaaagcctggttagctatattagcagcctg

SEQ ID NO: 5480 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADMSLAKGGSSYESLESLVSYISSL

SEQ ID NO: 5481 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgcaggataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaaacactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5482 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPQDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5483 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgttaagcgtgaaattccggcgccgagcttcctgcttccgctgccgaagcactatagggcgagcagcagcagcctgctggacgaagatccgagcgtgttccaatggctggaccagcaaccgcctagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5484 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVKREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5485 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatccgttccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5486 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADPFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5487 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgttgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgtcgctgaaggataaagcggatgtgagcctggctaagggtggcagcagctacgagagcctggaaagcctggttagctatattagcagcctg

SEQ ID NO: 5488 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAASLKDKADVSLAKGGSSYESLESLVSYISSL

SEQ ID NO: 5489 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtgtcgggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5490 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVSGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5491 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcaccctgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5492 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHPAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5493 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcggcgggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5494 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIAAGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5495 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtgctaacgcggcggttctgaaggataaagcggatgtgagcctggctaagggtggcagcagctacgagagcctggaaagcctggttagctatattagcagcctg

SEQ ID NO: 5496 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRANAAVLKDKADVSLAKGGSSYESLESLVSYISSL

SEQ ID NO: 5497 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgttgtgcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5498 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVVREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5499 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccggaggataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5500 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPEDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5501 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatacgagcctggctaagggtggcagcagctacgagagcctggaaagcctggttagctatattagcagcctg

SEQ ID NO: 5502 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADTSLAKGGSSYESLESLVSYISSL

SEQ ID NO: 5503 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttgcggagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5504 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFAELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5505 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaggctgaaggataaagcggatgtgagcctggctaagggtggcagcagctacgagagcctggaaagcctggttagctatattagcagcctg

SEQ ID NO: 5506 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAARLKDKADVSLAKGGSSYESLESLVSYISSL

SEQ ID NO: 5507 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgcagctgaaggataaagcggatgtgagcctggctaagggtggcagcagctacgagagcctggaaagcctggttagctatattagcagcctg

SEQ ID NO: 5508 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAQLKDKADVSLAKGGSSYESLESLVSYISSL

SEQ ID NO: 5509 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgttttgcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5510 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVLREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5511 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgctgtttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5512 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPLFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5513 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgtttctgaaggataaagcggatgtgagcctggctaagggtggcagcagctacgagagcctggaaagcctggttagctatattagcagcctg

SEQ ID NO: 5514 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAFLKDKADVSLAKGGSSYESLESLVSYISSL

SEQ ID NO: 5515 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagccagggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5516 - protein, 457 aa, Artificial Sequence
  "Variant of ADP-beta-1,3-glucosyltransferase"
MENKTETTVRRRRVILFPVPFPGHINPMLQLANVLYSQGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5517 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcgcaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5518 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5519 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacagggcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5520 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHRAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5521 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgataattaacgagcacggcgcggatgaattccgtaaagagctggaaagcctgatgtctgatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5522 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMSDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5523 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaaatcgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5524 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKNRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5525 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggattgtagcctggctaagggtggcagcagctacgagagcctggaaagcctggttagctatattagcagcctg

SEQ ID NO: 5526 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADCSLAKGGSSYESLESLVSYISSL

SEQ ID NO: 5527 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgatgtgacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5528 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDVTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5529 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcgcgtgttctgaaggataaagcggatgtgagcctggctaagggtggcagcagctacgagagcctggaaagcctggttagctatattagcagcctg

SEQ ID NO: 5530 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNARVLKDKADVSLAKGGSSYESLESLVSYISSL

SEQ ID NO: 5531 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttctatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5532 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRSILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5533 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcacgtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5534 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSTWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5535 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgttgggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5536 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVGREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5537 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacactgatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5538 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDTDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5539 - DNA, 1371 bp, Artificial Sequence
  "Variant of ADP-beta-1,3-glucosyltransferase"
atggagaacaaaaccgaaccgaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaacgatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5540 - protein, 457 aa, Artificial Sequence
  "Variant of ADP-beta-1,3-glucosyltransferase"
MENKTEPTVRRRRVILFPVPFPGHINPMLQLANVLYSRGFSITIFHTNFNAPKTSLYPHFTFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5541 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacgccccgaaaaccagcctttatccgcacttcacctttcgttttatcttggacaaggatccgcaggacgagtggcttcgcaacctgccgacccatggtccgggcgcgggttggataatcccgatcattaacgagcacggcgcggatgaattccgtaaagagctggaaagcctgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaagcgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 5542 - protein, 457 aa, Artificial Sequence
  "Variant of ADP-beta-1,3-glucosyltransferase"
MENKTETTVRRRRVILFPVPFPGHINPMLQLANVLYSRGFSITIFHTNFNAPKTSLYPHFTFRFILDKDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAVLKDKADVSLAKGGSSYESLESLVSYISSL

SEQ ID NO: 5543 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaaccggtggtaggtttcccgatgctgaaggttaaagatatcaaacgcgcgtatagcaattggcaggatgccaaagaaattctggataagatgattaaagaaacccgtgcgagcagcggtgtgatttggaacagctttaaagagctggaggaaagcgagctggaaaccgtttggcgtgaaattccggcgccgagcttcctgcttccgctgccgaagcacataagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5544 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMIIPIINEHGADEFRKELESLMRDSPEDEEVACLITDALWYFAQPVADSLNLPRLVLMTSSLFNFHALVSLPNFLELGYLDPGDKTRLEEPVVGFPMLKVKDIKRAYSNWQDAKEILDKMIKETRASSGVIWNSFKELEESELETVWREIPAPSFLLPLPKHIRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5545 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggagaatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgccaaagaaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcacataagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5546 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWRIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIEETRASSGVIWNSFKELEESELETVWREIPAPSFLLPLPKHIRASSSSLLDEDPSVFQWLDQQPPSSVLYVGFGTQSEVDEKDFLEIARGLVDSKQSFLWRVRPGFVKGSEWIEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5547 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaaccggtggtaggtttcccgatgctgaaggttaaagatatcaaacgcgcgtatagcaattggcaggaagccaaagaaattctggataagatgattaaagaaacccgtgcgagcagcggtgtgatttggaacagctttaaagagctggaggaaagcgagctggaaaccgtttggcgtgaaattccggcgccgagcttcctgcttccgctgccgaagcacataagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5548 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINEHGADEFRKELESLMRDSPEDEEVACLITDALWYFAQPVADSLNLPRLVLMTSSLFNFHALVSLPNFLELGYLDPGDKTRLEEPVVGFPMLKVKDIKRAYSNWQEAKEILDKMIKETRASSGVIWNSFKELEESELETVWREIPAPSFLLPLPKHIRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5549 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5550 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5551 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaacaggtggtaggtttcccgatgctgaaggttaaagatatcaaacgcgcgtatagcaattggcagatagccaaagaaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5552 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPQFLELGYLDPGDKTRLEEQVVGFPMLKVKDIKRAYSNWQIAKEILDKMIEETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWIEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5553 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaggtggtaggtttcccgatgctgaaggttaaagatatcaaacgcgcgtatagcaattggcaggaaaaaaaagaaattctggataagatgattaaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5554 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQEKKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5555 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaggtggtaggtttcccgatgctgaaggttaaagatatcaaacgcgcgtatagcaattggcaggaagccaaagaaattctggataagatgattaaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5556 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQEAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5557 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggagaatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaggtggtaggtttcccgatgctgaaggttaaagatatcaaacgcgcgtatagcaattggcaggatgccaaagaaattctggataagatgattaaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5558 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWRIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWIEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5559 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaggtggtaggtttcccgatgctgaaggttaaagatatcaaacgcgcgtatagcaattggcaggatgccaaagaaattctggataagatgattaaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5560 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5561 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5562 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5563 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5564 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIEETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5565 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggagaatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaaccggtggtaggtttcccgatgctgaaggttaaagatatcaaacgcgcgtatagcaattggcaggatgccaaagaaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5566 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWRIPIINEHGADEFRKELESLMRDSPEDEEVACLITDALWYFAQPVADSLNLPRLVLMTSSLFNFHALVSLPNFLELGYLDPGDKTRLEEPVVGFPMLKVKDIKRAYSNWQDAKEILDKMIEETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5567 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggagaatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcagatagccaaagaaattctggataagatgattaaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5568 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWRIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQIAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5569 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgcccaggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5570 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIEETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5571 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggagaatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5572 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWRIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5573 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaacaggtggtaggtttcccgatgctgaaggttaaagatatcaaacgcgcgtatagcaattggcaggaagccaaagaaattctggataagatgattaaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaaggggagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5574 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINEHGADEFRKELESLMRDSPEDEEVACLITDALWYFAQPVADSLNLPRLVLMTSSLFNFHALVSLPQFLELGYLDPGDKTRLEEQVVGFPMLKVKDIKRAYSNWQEAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5575 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaggtggtaggtttcccgatgctgaaggttaaagatatcaaacgcgcgtatagcaattggcaggatgccaaagaaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5576 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIEETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWIEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5577 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaaccggtggtaggtttcccgatgctgaaggttaaagatatcaaacgcgcgtatagcaattggcaggaagccaaagaaattctggataagatgattaaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5578 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEPVVGFPMLKVKDIKRAYSNWQEAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5579 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaaccggtggtaggtttcccgatgctgaaggttaaagatatcaaacgcgcgtatagcaattggcaggatgccaaagaaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5580 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEPVVGFPMLKVKDIKRAYSNWQDAKEILDKMIEETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5581 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5582 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5583 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5584 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMIIPIINEHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5585 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggagaatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5586 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWRIPIINEHGADEFRKELESLMRDSPEDEEVACLITDALWYFAQPVADSLNLPRLVLMTSSLFNFHALVSLPNFLELGYLDPGDKTRLEEPVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWIEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5587 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5588 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMIIPIINEHGADEFRKELESLMRDSPEDEEVACLITDALWYFAQPVADSLNLPRLVLMTSSLFNFHALVSLPQFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWIEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5589 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggaagccaaagaaattctggataagatgattaaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5590 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQEAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5591 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaggtggtaggtttcccgatgctgaaggttaaagatatcaaacgcgcgtatagcaattggcaggatgccaaagaaattctggataagatgattaaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5592 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWIEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5593 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggagaatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaggtggtaggtttcccgatgctgaaggttaaagatatcaaacgcgcgtatagcaattggcaggataaaaaagaaattctggataagatgattaaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5594 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWRIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDKKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5595 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggagaatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaggtggtaggtttcccgatgctgaaggttaaagatatcaaacgcgcgtatagcaattggcaggataaaaaagaaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5596 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWRIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDKKEILDKMIEETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5597 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaggtggtaggtttcccgatgctgaaggttaaagatatcaaacgcgcgtatagcaattggcaggaagccaaagaaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5598 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQEAKEILDKMIEETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWIEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5599 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggagaatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5600 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWRIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIEETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5601 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggagaatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5602 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWRIPIINEHGADEFRKELESLMRDSPEDEEVACLITDALWYFAQPVADSLNLPRLVLMTSSLFNFHALVSLPNFLELGYLDPGDKTRLEEPVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5603 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgaaaagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5604 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPKSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5605 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggggcagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5606 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLGQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5607 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggataactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5608 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLDNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5609 - DNA, 1371 bp, Artificial Sequence
  "Variant of ADP-beta-1,3-glucosyltransferase"
atgcacaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5610 - protein, 457 aa, Artificial Sequence
  "Variant of ADP-beta-1,3-glucosyltransferase"
MHNKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5611 - DNA, 1371 bp, Artificial Sequence
  "Variant of ADP-beta-1,3-glucosyltransferase"
atgggcaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5612 - protein, 457 aa, Artificial Sequence
  "Variant of ADP-beta-1,3-glucosyltransferase"
MGNKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5613 - DNA, 1371 bp, Artificial Sequence
  "Variant of ADP-beta-1,3-glucosyltransferase"
atgccgaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5614 - protein, 457 aa, Artificial Sequence
  "Variant of ADP-beta-1,3-glucosyltransferase"
MPNKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5615 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttcgtgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5616 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFRDFGLDQPLNARYMSDVLKVGVYLENGLERGEIENAIRRVMVDREGEVMRQNAAKLKDKADVSLAKGGSSYESLESLVSYISSL

SEQ ID NO: 5617 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacgcgctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5618 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADALNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5619 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgatacaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5620 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDTTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5621 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagccttggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5622 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASLGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5623 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaaccaatctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5624 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTNLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5625 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagccccctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5626 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSPLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5627 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcactgctaagggtggcagcagctacgagagcctggaaagcctggttagctatattagcagcctg

SEQ ID NO: 5628 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSTAKGGSSYESLESLVSYISSL

SEQ ID NO: 5629 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgcaagacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5630 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLQDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5631 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcattgctaagggtggcagcagctacgagagcctggaaagcctggttagctatattagcagcctg

SEQ ID NO: 5632 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSIAKGGSSYESLESLVSYISSL

SEQ ID NO: 5633 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttcgggagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5634 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFRELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5635 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcgagcagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5636 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVASSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5637 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttaaggatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5638 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFKDFGLDQPLNARYMSDVLKVGVYLENGLERGEIENAIRRVMVDREGEVMRQNAAKLKDKADVSLAKGGSSYESLESLVSYISSL

SEQ ID NO: 5639 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaagatgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5640 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIEDAIRRVMVDREGEVMRQNAAKLKDKADVSLAKGGSSYESLESLVSYISSL

SEQ ID NO: 5641 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggagaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5642 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLENFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5643 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5644 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPSDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5645 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctggacgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5646 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLDVGVYLENGLERGEIENAIRRVMVDREGEVMRQNAAKLKDKADVSLAKGGSSYESLESLVSYISSL

SEQ ID NO: 5647 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagcaggattagcagcctg

SEQ ID NO: 5648 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSRISSL

SEQ ID NO: 5649 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctgcgggtggcagcagctacgagagcctggaaagcctggttagctatattagcagcctg

SEQ ID NO: 5650 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAAGGSSYESLESLVSYISSL

SEQ ID NO: 5651 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagccattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5652 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSHWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5653 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagccggcaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5654 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSRQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5655 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctggctgacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5656 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLADEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5657 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcatgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5658 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRHVMVDREGEVMRQNAAKLKDKADVSLAKGGSSYESLESLVSYISSL

SEQ ID NO: 5659 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaccgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5660 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGDRGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5661 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccctctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5662 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTPLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5663 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggaggacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5664 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLEDGLERGEIENAIRRVMVDREGEVMRQNAAKLKDKADVSLAKGGSSYESLESLVSYISSL

SEQ ID NO: 5665 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgattgtattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5666 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDCIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5667 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggggagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5668 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVAGSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5669 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaactgatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5670 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDETDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5671 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcgggagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5672 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASGSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5673 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgggagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5674 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVGSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5675 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacccttggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5676 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDPWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5677 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacgctaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5678 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNANAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5679 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctgcaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5680 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLHQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5681 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggcgcagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5682 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLAQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5683 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacacgagcctggaaagcctggttagctatattagcagcctg

SEQ ID NO: 5684 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYTSLESLVSYISSL

SEQ ID NO: 5685 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacacctggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5686 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDTWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5687 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattcaacgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5688 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIQRVMVDREGEVMRQNAAKLKDKADVSLAKGGSSYESLESLVSYISSL

SEQ ID NO: 5689 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggataatcccgatcattaacgagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaactttttagagcttggctacctggatccgggtgataaaacccgtctggaggaacaagtggtaggtttcccgatgctgaaggttaaagatatcaaacgcgcgtatagcaattggcaggatgctaaagaaattctggataagatgattaaggaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcgtggctaagggtggcagcagctacgagagcctggaaagcctggttagctatattagcagcctg

SEQ ID NO: 5690 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWIIPIINEHGADEFRKELESLMRDSPEDEEVACLITDALWYFAQPVADSLNLPRLVLMTSSLFNFHALVSLPNFLELGYLDPGDKTRLEEQVVGFPMLKVKDIKRAYSNWQDAKEILDKMIKETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSVAKGGSSYESLESLVSYISSL

SEQ ID NO: 5691 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttctatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaaacccgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcaccctgcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtaagcctggctaagggtggcagcagctacgagagcctggaaagcctggttagctatattagcagcctg

SEQ ID NO: 5692 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRSILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKTRLEEPVVGFPMLKVKDIKRAYSNWQDAKPILDKMIEETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHPAIGAFWTHGGWNGTMEGVAEGVPMIFSDFGLDQPLNARYMSDVLHVGVYLENGLERGEIENAIRRVMVDREGEVMRQNAAKLKDKADVSLAKGGSSYESLESLVSYISSL

SEQ ID NO: 5693 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaaacacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggagatacaacccgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5694 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDTTRLEEPVVGFPMLKVKDIKRAYSNWQDAKPILDKMIEETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLHVGVYLENGLERGEIENAIRRVMVDPEGEVMRQNAAKLKDKADVSLAKGGSSYESLESLVSYISSL

SEQ ID NO: 5695 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaaacacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagatacacatcgtctggaggaaccggtggtaggtttcccgatgctgaaggttaaagatatcaaacgcgcgtatagcaattggcaggatgctaaagagattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcaaagcctggctaagggtggcagcagctacgagagcctggaaagcctggttagctatattagcagcctg

SEQ ID NO: 5696 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDTHRLEEPVVGFPMLKVKDIKRAYSNWQDAKEILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLHVGVYLENGLERGEIENAIRRVMVDREGEVMRQNAAKLKDKADQSLAKGGSSYESLESLVSYISSL

SEQ ID NO: 5697 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacggtgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtaagcctggctaagggtggcagcagctacgagagcctggaaagcctggttagctatattagcagcctg

SEQ ID NO: 5698 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHGAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5699 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgaccattaacaaacacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggagataaaacccgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacggtgcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgggaaggtgaggtgatgcgtcaaaacgcggcgaaactgaaggataaagcggatgtaagcctggctaagggtggcagcagctacgagagcctggaaagcctggttagctatattagcagcctg

SEQ ID NO: 5700 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPTINKHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHGAIGAFWTHGGWNGTMEGVAEGVPMIFSDFGLDQPLNARYMSDVLHVGVYLENGLERGEIENAIRRVMVDREGEVMRQNAAKLKDKADVSLAKGGSSYESLESLVSYISSL

SEQ ID NO: 5701 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacggtgcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgggaaggtgaggtgatgcgtcaaaacgcggcgaaactgaaggataaagcggatgtaagcctggctaagggtggcagcagctacgagagcctggaaagcctggttagctatattagcagcctg

SEQ ID NO: 5702 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHGAIGAFWTHGGWNGTMEGVAEGVPMIFSDFGLDQPLNARYMSDVLHVGVYLENGLERGEIENAIRRVMVDREGEVMRQNAAKLKDKADVSLAKGGSSYESLESLVSYISSL

SEQ ID NO: 5703 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagatacaacccgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgggaaggtgaggtgatgcgtcaaaacgcggcgaaactgaaggataaagcggatcaaagcctggctaagggtggcagcagctacgagagcctggaaagcctggttagctatattagcagcctg

SEQ ID NO: 5704 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDTTRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLHVGVYLENGLERGEIENAIRRVMVDREGEVMRQNAAKLKDKADQSLAKGGSSYESLESLVSYISSL

SEQ ID NO: 5705 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcaccctgcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcaaagcctggctaagggtggcagcagctacgagagcctggaaagcctggttagctatattagcagcctg

SEQ ID NO: 5706 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHPAIGAFWTHGGWNGTMEGVAEGVPMIFSDFGLDQPLNARYMSDVLHVGVYLENGLERGEIENAIRRVMVDREGEVMRQNAAKLKDKADQSLAKGGSSYESLESLVSYISSL

SEQ ID NO: 5707 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 5708 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 5709 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaaacacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggagataaaacccgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 5710 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAKGGSSYESLESLVSYISSL

SEQ ID NO: 5711 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 5712 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDPEGEVMRQNAAKLKDKADRSLAKGGSSYESLESLVSYISSL

SEQ ID NO: 5713 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttctatcttggacaacgatccgcaggacgagtggcttcgcaacctgccgacccatggtccgggcgcgggtatgagaatcccgatcattaacaaacacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggagataaacatcgtctggaggaaccggtggtaggtttcccgatgctgaaggttaaagatatcaaacgcgcgtatagcaattggcaggatgctaaagagattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggtccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcaccctgcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5714 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRSILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKHRLEEPVVGFPMLKVKDIKRAYSNWQDAKEILDKMIEETRASSGVIWNSFKELEESELETVWREIPAPSFLLPLPKHYRASSSSLLDEDPSVAQWLVQQPPSSVLYVGFGTQSEVDEKDFLEIARGLVDSKQSFLWRVRPGFVKGSEWVEPLPDGFLGERGRIVKSCPQQEVLAHPAIGAFWTHGGWNGTMEGVAEGVPMIFSDFGLDQPLNARYMSDVLHVGVYLENGLERGEIENAIRRVMVDPEGEVMRQNAAKLKDKADVSLAKGGSSYESLESLVSYISSL

SEQ ID NO: 5715 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaaacacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggagataaaacccgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 5716 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLKVGVYLENGLERGEIENAIRRVMVDPEGEVMRQNAAKLKDKADRSLAKGGSSYESLESLVSYISSL

SEQ ID NO: 5717 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgaccattaacgaacacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggagatacacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacggtgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgggaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5718 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPTINEHGADEFRKELESLMRDSPEDEEVACLITDALWYFAQPVADSLNLPRLVLMTSSLFNFHALVSLPQFLELGYLDPGDTHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHGAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5719 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaaacacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggagatacacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 5720 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDTHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLHVGVYLENGLERGEIENAIRRVMVDPEGEVMRQNAAKLKDKADRSLAKGGSSYESLESLVSYISSL

SEQ ID NO: 5721 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacgaacacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacggtgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgggaaggtgaggtgatgcgtcaaaacgcggcgaaactgaaggataaagcggatcaaagcctggctaagggtggcagcagctacgagagcctggaaagcctggttagctatattagcagcctg

SEQ ID NO: 5722 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINEHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHGAIGAFWTHGGWNGTMEGVAEGVPMIFSDFGLDQPLNARYMSDVLKVGVYLENGLERGEIENAIRRVMVDREGEVMRQNAAKLKDKADQSLAKGGSSYESLESLVSYISSL

SEQ ID NO: 5723 - DNA, 1371 bp, Artificial Sequence
  "Variant of ADP-beta-1,3-glucosyltransferase"
atggagaacaaaaccgaaacgaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcggaaagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtcgcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaatgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5724 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVWREIPAPSFLLPLPKHYRAESSSLLDEDPSVFQWLDQQPPSSVLYVGFGTQSEVDEKDFLEIARGLVDSKQSFLWRVRPGFVKGREWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5725 - DNA, 1371 bp, Artificial Sequence
  "Variant of ADP-beta-1,3-glucosyltransferase"
atggaaaacaaaaccgaaacgaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcttgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaatgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5726 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVKREIPAPSFLLPLPKHYRAESSSLLDEDPSVFQWLDQQPPSSVLYVGFGTQSEVDEKDFLEIARGLVDSKQSFLWRVRPGFVKGSEWIEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5727 - DNA, 1371 bp, Artificial Sequence
  "Variant of ADP-beta-1,3-glucosyltransferase"
atggaaaacaaaaccgaaacgaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtcgcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaacgggcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5728 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVKREIPAPSFLLPLPKHYRAESSSLLDEDPSVFQWLDQQPPSSVLYVGFGTQSEVDEKDFLEIARGLVDSKQSFLWRVRPGFVKGREWVEPLPDGFLGERGRIVKSCPQQEVLAHDAIGAFWTHGGWNGTMEGVAEGVPMIFSDFGLDQPLNARYMSDVLKVGVYLENGLERGEIERAIRRVMVDREGEVMRQNAAKLKDKADVSLAKGGSSYESLESLVSYISSL

SEQ ID NO: 5729 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcagacgcgcgtatagcaattggcaggatgctaaagaaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaacgggcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5730 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIRRAYSNWQDAKEILDKMIEETRASSGVIWNSFKELEESELETVKREIPAPSFLLPLPKHYRAESSSLLDEDPSVFQWLDQQPPSSVLYVGFGTQSEVDEKDFLEIARGLVDSKQSFLWRVRPGFVKGSEWIEPLPDGFLGERGRIVKSCPQQEVLAHDAIGAFWTHGGWNGTMEGVAEGVPMIFSDFGLDQPLNARYMSDVLKVGVYLENGLERGEIERAIRRVMVDREGEVMRQNAAKLKDKADVSLAKGGSSYESLESLVSYISSL

SEQ ID NO: 5731 - DNA, 1371 bp, Artificial Sequence
  "Variant of ADP-beta-1,3-glucosyltransferase"
atggaaaacaaaaccgaaacgaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcagacgcgcgtatagcaattggcaggatgctaaagaaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtcgcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaatgcgattaggcgtgtgatggttgaccgtgaaggtgaggtgatgcgtcaaaacgcggccaaactgaaggataaagcggatgtgagcctggctaagggtggcagcagctacgagagcctggaaagcctggttagctatattagcagcctg

SEQ ID NO: 5732 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPGDKTRLEEPVVGFPMLKVKDIRRAYSNWQDAKEILDKMIEETRASSGVIWNSFKELEESELETVKREIPAPSFLLPLPKHYRAESSSLLDEDPSVFQWLDQQPPSSVLYVGFGTQSEVDEKDFLEIARGLVDSKQSFLWRVRPGFVKGREWIEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5733 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcttgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgcccaggcttcgtgaagggtcgcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaatgcgattaggcgtgtgatggttgaccgtgaaggtgaggtgatgcgtcaaaacgcgcgcaaactgaaggataaagcggatgtgagcctggctaagggtggcagcagctacgagagcctggaaagcctggttagctatattagcagcctg

SEQ ID NO: 5734 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVKREIPAPSFLLPLPKHYRAESSSLLDEDPSVFQWLDQQPPSSVLYVGFGTQSEVDEKDFLEIARGLVDSKQSFLWRVRPGFVKGREWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNARKLKDKADVSLAKGGSSYESLESLVSYISSL

SEQ ID NO: 5735 - DNA, 1371 bp, Artificial Sequence
  "Variant of ADP-beta-1,3-glucosyltransferase"
atggagaacaaaaccgaaccgaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcttgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcagacgcgcgtatagcaattggcaggatgctaaagaaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtcgcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaatgcgattaggcgtgtgatggttgaccgtgaaggtgaggtgatgcgtcaaaacgcgcgcagactgaaggataaagcggatgtgagcctggctaagggtggcagcagctacgagagcctggaaagcctggttagctatattagcagcctg

SEQ ID NO: 5736 - protein, 457 aa, Artificial Sequence
  "Variant of ADP-beta-1,3-glucosyltransferase"
MENKTEPTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIRRAYSNWQDAKEILDKMIEETRASSGVIWNSFKELEESELETVKREIPAPSFLLPLPKHYRAESSSLLDEDPSVFQWLDQQPPSSVLYVGFGTQSEVDEKDFLEIARGLVDSKQSFLWRVRPGFVKGREWIEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNARRLKDKADVSLAKGGSSYESLESLVSYISSL

SEQ ID NO: 5737 - DNA, 1371 bp, Artificial Sequence
  "Variant of ADP-beta-1,3-glucosyltransferase"
atggagaacaaaaccgaaccgaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaggcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggccaaactgaaggataaagcggatgtgagcctggctaagggtggcagcagctacgagagcctggaaagcctggttagctatattagcagcctg

SEQ ID NO: 5738 - protein, 457 aa, Artificial Sequence
  "Variant of ADP-beta-1,3-glucosyltransferase"
MENKTEPTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVKREIPAPSFLLPLPKHYRAEGSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5739 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcttgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaacgggcgattaggcgtgtgatggttgaccgtgaaggtgaggtgatgcgtcaaaacgcggccagactgaaggataaagcggatgtgagcctggctaagggtggcagcagctacgagagcctggaaagcctggttagctatattagcagcctg

SEQ ID NO: 5740 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVKREIPAPSFLLPLPKHYRAESSSLLDEDPSVFQWLDQQPPSSVLYVGFGTQSEVDEKDFLEIARGLVDSKQSFLWRVRPGFVKGSEWIEPLPDGFLGERGRIVKSCPQQEVLAHDAIGAFWTHGGWNGTMEGVAEGVPMIFSDFGLDQPLNARYMSDVLKVGVYLENGLERGEIERAIRRVMVDREGEVMRQNAARLKDKADVSLAKGGSSYESLESLVSYISSL

SEQ ID NO: 5741 - DNA, 1371 bp, Artificial Sequence
  "Variant of ADP-beta-1,3-glucosyltransferase"
atggaaaacaaaaccgaaccgaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcttgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaggcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaacgggcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5742 - protein, 457 aa, Artificial Sequence
  "Variant of ADP-beta-1,3-glucosyltransferase"
MENKTEPTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVKREIPAPSFLLPLPKHYRAEGSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIERAIRRVMVDREGEVMRQNAAKLKDKADVSLAKGGSSYESLESLVSYISSL

SEQ ID NO: 5743 - DNA, 1371 bp, Artificial Sequence
  "Variant of ADP-beta-1,3-glucosyltransferase"
atggaaaacaaaaccgaaacgaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcttgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaggcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaacgggcgattaggcgtgtgatggttgaccgtgaaggtgaggtgatgcgtcaaaacgcgctcaaactgaaggataaagcggatgtgagcctggctaagggtggcagcagctacgagagcctggaaagcctggttagctatattagcagcctg

SEQ ID NO: 5744 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVKREIPAPSFLLPLPKHYRAEGSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIERAIRRVMVDREGEVMRQNALKLKDKADVSLAKGGSSYESLESLVSYISSL

SEQ ID NO: 5745 - DNA, 1371 bp, Artificial Sequence
  "Variant of ADP-beta-1,3-glucosyltransferase"
atggaaaacaaaaccgaaccgaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcagacgcgcgtatagcaattggcaggatgctaaagaaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaggcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaatgcgattaggcgtgtgatggttgaccgtgaaggtgaggtgatgcgtcaaaacgcgctcaaactgaaggataaagcggatgtgagcctggctaagggtggcagcagctacgagagcctggaaagcctggttagctatattagcagcctg

SEQ ID NO: 5746 - protein, 457 aa, Artificial Sequence
  "Variant of ADP-beta-1,3-glucosyltransferase"
MENKTEPTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIRRAYSNWQDAKEILDKMIEETRASSGVIWNSFKELEESELETVKREIPAPSFLLPLPKHYRAEGSSLLDEDPSVFQWLDQQPPSSVLYVGFGTQSEVDEKDFLEIARGLVDSKQSFLWRVRPGFVKGSEWIEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNALKLKDKADVSLAKGGSSYESLESLVSYISSL

SEQ ID NO: 5747 - DNA, 1371 bp, Artificial Sequence
  "Variant of ADP-beta-1,3-glucosyltransferase"
atggaaaacaaaaccgaaccgaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaggcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtcgcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaacgggcgattaggcgtgtgatggttgaccgtgaaggtgaggtgatgcgtcaaaacgcgctcaaactgaaggataaagcggatgtgagcctggctaagggtggcagcagctacgagagcctggaaagcctggttagctatattagcagcctg

SEQ ID NO: 5748 - protein, 457 aa, Artificial Sequence
  "Variant of ADP-beta-1,3-glucosyltransferase"
MENKTEPTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVKREIPAPSFLLPLPKHYRAEGSSLLDEDPSVFQWLDQQPPSSVLYVGFGTQSEVDEKDFLEIARGLVDSKQSFLWRVRPGFVKGREWVEPLPDGFLGERGRIVKSCPQQEVLAHDAIGAFWTHGGWNGTMEGVAEGVPMIFSDFGLDQPLNARYMSDVLKVGVYLENGLERGEIERAIRRVMVDREGEVMRQNALKLKDKADVSLAKGGSSYESLESLVSYISSL

SEQ ID NO: 5749 - DNA, 1371 bp, Artificial Sequence
  "Variant of ADP-beta-1,3-glucosyltransferase"
atggagaacaaaaccgaaccgaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtcgcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaacgggcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5750 - protein, 457 aa, Artificial Sequence
  "Variant of ADP-beta-1,3-glucosyltransferase"
MENKTEPTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVKREIPAPSFLLPLPKHYRAESSSLLDEDPSVFQWLDQQPPSSVLYVGFGTQSEVDEKDFLEIARGLVDSKQSFLWRVRPGFVKGREWVEPLPDGFLGERGRIVKSCPQQEVLAHDAIGAFWTHGGWNGTMEGVAEGVPMIFSDFGLDQPLNARYMSDVLKVGVYLENGLERGEIERAIRRVMVDREGEVMRQNAAKLKDKADVSLAKGGSSYESLESLVSYISSL

SEQ ID NO: 5751 - DNA, 1371 bp, Artificial Sequence
  "Variant of ADP-beta-1,3-glucosyltransferase"
atggagaacaaaaccgaaccgaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcagacgcgcgtatagcaattggcaggatgctaaagaaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaggcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtcgcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaacgggcgattaggcgtgtgatggttgaccgtgaaggtgaggtgatgcgtcaaaacgcgcgcaaactgaaggataaagcggatgtgagcctggctaagggtggcagcagctacgagagcctggaaagcctggttagctatattagcagcctg

SEQ ID NO: 5752 - protein, 457 aa, Artificial Sequence
  "Variant of ADP-beta-1,3-glucosyltransferase"
MENKTEPTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPGDKTRLEEPVVGFPMLKVKDIRRAYSNWQDAKEILDKMIEETRASSGVIWNSFKELEESELETVKREIPAPSFLLPLPKHYRAEGSSLLDEDPSVFQWLDQQPPSSVLYVGFGTQSEVDEKDFLEIARGLVDSKQSFLWRVRPGFVKGREWVEPLPDGFLGERGRIVKSCPQQEVLAHDAIGAFWTHGGWNGTMEGVAEGVPMIFSDFGLDQPLNARYMSDVLKVGVYLENGLERGEIERAIRRVMVDREGEVMRQNARKLKDKADVSLAKGGSSYESLESLVSYISSL

SEQ ID NO: 5753 - DNA, 1371 bp, Artificial Sequence
  "Variant of ADP-beta-1,3-glucosyltransferase"
atggaaaacaaaaccgaaccgaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtcgcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaatgcgattaggcgtgtgatggttgaccgtgaaggtgaggtgatgcgtcaaaacgcgctcaaactgaaggataaagcggatgtgagcctggctaagggtggcagcagctacgagagcctggaaagcctggttagctatattagcagcctg

SEQ ID NO: 5754 - protein, 457 aa, Artificial Sequence
  "Variant of ADP-beta-1,3-glucosyltransferase"
MENKTEPTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVKREIPAPSFLLPLPKHYRAESSSLLDEDPSVFQWLDQQPPSSVLYVGFGTQSEVDEKDFLEIARGLVDSKQSFLWRVRPGFVKGREWIEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNALKLKDKADVSLAKGGSSYESLESLVSYISSL

SEQ ID NO: 5755 - DNA, 1371 bp, Artificial Sequence
  "Variant of ADP-beta-1,3-glucosyltransferase"
atgaataacaaaaccgaaccgaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaggcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaatgcgattaggcgtgtgatggttgaccgtgaaggtgaggtgatgcgtcaaaacgcggccaaactgaaggataaagcggatgtgagcctggctaagggtggcagcagctacgagagcctggaaagcctggttagctatattagcagcctg

SEQ ID NO: 5756 - protein, 457 aa, Artificial Sequence
  "Variant of ADP-beta-1,3-glucosyltransferase"
MNNKTEPTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVKREIPAPSFLLPLPKHYRAEGSSLLDEDPSVFQWLDQQPPSSVLYVGFGTQSEVDEKDFLEIARGLVDSKQSFLWRVRPGFVKGSEWIEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5757 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcagacgcgcgtatagcaattggcaggatgctaaagaaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaggcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtcgcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaacgggcgattaggcgtgtgatggttgaccgtgaaggtgaggtgatgcgtcaaaacgcggccagactgaaggataaagcggatgtgagcctggctaagggtggcagcagctacgagagcctggaaagcctggttagctatattagcagcctg

SEQ ID NO: 5758 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIRRAYSNWQDAKEILDKMIEETRASSGVIWNSFKELEESELETVKREIPAPSFLLPLPKHYRAEGSSLLDEDPSVFQWLDQQPPSSVLYVGFGTQSEVDEKDFLEIARGLVDSKQSFLWRVRPGFVKGREWIEPLPDGFLGERGRIVKSCPQQEVLAHDAIGAFWTHGGWNGTMEGVAEGVPMIFSDFGLDQPLNARYMSDVLKVGVYLENGLERGEIERAIRRVMVDREGEVMRQNAARLKDKADVSLAKGGSSYESLESLVSYISSL

SEQ ID NO: 5759 - DNA, 1371 bp, Artificial Sequence
  "Variant of ADP-beta-1,3-glucosyltransferase"
atgctgaacaaaaccgaaccgaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcttgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaggcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaatgcgattaggcgtgtgatggttgaccgtgaaggtgaggtgatgcgtcaaaacgcgcgcagactgaaggataaagcggatgtgagcctggctaagggtggcagcagctacgagagcctggaaagcctggttagctatattagcagcctg

SEQ ID NO: 5760 - protein, 457 aa, Artificial Sequence
  "Variant of ADP-beta-1,3-glucosyltransferase"
MLNKTEPTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVKREIPAPSFLLPLPKHYRAEGSSLLDEDPSVFQWLDQQPPSSVLYVGFGTQSEVDEKDFLEIARGLVDSKQSFLWRVRPGFVKGSEWIEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNARRLKDKADVSLAKGGSSYESLESLVSYISSL

SEQ ID NO: 5761 - DNA, 1371 bp, Artificial Sequence
  "Variant of ADP-beta-1,3-glucosyltransferase"
atggagaacaaaaccgaaacgaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcttgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaggcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtcgcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaatgcgattaggcgtgtgatggttgaccgtgaaggtgaggtgatgcgtcaaaacgcgcgcagactgaaggataaagcggatgtgagcctggctaagggtggcagcagctacgagagcctggaaagcctggttagctatattagcagcctg

SEQ ID NO: 5762 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVKREIPAPSFLLPLPKHYRAEGSSLLDEDPSVFQWLDQQPPSSVLYVGFGTQSEVDEKDFLEIARGLVDSKQSFLWRVRPGFVKGREWIEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNARRLKDKADVSLAKGGSSYESLESLVSYISSL

SEQ ID NO: 5763 - DNA, 1371 bp, Artificial Sequence
  "Variant of ADP-beta-1,3-glucosyltransferase"
atggaaaacaaaaccgaaccgaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcttgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtcgcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaatgcgattaggcgtgtgatggttgaccgtgaaggtgaggtgatgcgtcaaaacgcggccagactgaaggataaagcggatgtgagcctggctaagggtggcagcagctacgagagcctggaaagcctggttagctatattagcagcctg

SEQ ID NO: 5764 - protein, 457 aa, Artificial Sequence
  "Variant of ADP-beta-1,3-glucosyltransferase"
MENKTEPTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVKREIPAPSFLLPLPKHYRAESSSLLDEDPSVFQWLDQQPPSSVLYVGFGTQSEVDEKDFLEIARGLVDSKQSFLWRVRPGFVKGREWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAARLKDKADVSLAKGGSSYESLESLVSYISSL

SEQ ID NO: 5765 - DNA, 1371 bp, Artificial Sequence
  "Variant of ADP-beta-1,3-glucosyltransferase"
atgaataacaaaaccgaaacgaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtcgcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5766 - protein, 457 aa, Artificial Sequence
  "Variant of ADP-beta-1,3-glucosyltransferase"
MNNKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVKREIPAPSFLLPLPKHYRAESSSLLDEDPSVFQWLDQQPPSSVLYVGFGTQSEVDEKDFLEIARGLVDSKQSFLWRVRPGFVKGREWIEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5767 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaggcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaatgcgattaggcgtgtgatggttgaccgtgaaggtgaggtgatgcgtcaaaacgcggccaaactgaaggataaagcggatgtgagcctggctaagggtggcagcagctacgagagcctggaaagcctggttagctatattagcagcctg

SEQ ID NO: 5768 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVKREIPAPSFLLPLPKHYRAEGSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5769 - DNA, 1371 bp, Artificial Sequence
  "Variant of ADP-beta-1,3-glucosyltransferase"
atggaaaacaaaaccgaaccgaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtcgcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaatgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5770 - protein, 457 aa, Artificial Sequence
  "Variant of ADP-beta-1,3-glucosyltransferase"
MENKTEPTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVKREIPAPSFLLPLPKHYRAESSSLLDEDPSVFQWLDQQPPSSVLYVGFGTQSEVDEKDFLEIARGLVDSKQSFLWRVRPGFVKGREWIEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5771 - DNA, 1371 bp, Artificial Sequence
  "Variant of ADP-beta-1,3-glucosyltransferase"
atggagaacaaaaccgaaccgaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcttgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcagacgcgcgtatagcaattggcaggatgctaaagaaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaacgggcgattaggcgtgtgatggttgaccgtgaaggtgaggtgatgcgtcaaaacgcgcgcaaactgaaggataaagcggatgtgagcctggctaagggtggcagcagctacgagagcctggaaagcctggttagctatattagcagcctg

SEQ ID NO: 5772 - protein, 457 aa, Artificial Sequence
  "Variant of ADP-beta-1,3-glucosyltransferase"
MENKTEPTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIRRAYSNWQDAKEILDKMIEETRASSGVIWNSFKELEESELETVKREIPAPSFLLPLPKHYRAESSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIERAIRRVMVDREGEVMRQNARKLKDKADVSLAKGGSSYESLESLVSYISSL

SEQ ID NO: 5773 - DNA, 1371 bp, Artificial Sequence
  "Variant of ADP-beta-1,3-glucosyltransferase"
atggagaacaaaaccgaaacgaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcttgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcagacgcgcgtatagcaattggcaggatgctaaagaaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaatgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5774 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIRRAYSNWQDAKEILDKMIEETRASSGVIWNSFKELEESELETVKREIPAPSFLLPLPKHYRAESSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5775 - DNA, 1371 bp, Artificial Sequence
  "Variant of ADP-beta-1,3-glucosyltransferase"
atggagaacaaaaccgaaacgaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcagacgcgcgtatagcaattggcaggatgctaaagaaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaatgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5776 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPGDKTRLEEPVVGFPMLKVKDIRRAYSNWQDAKEILDKMIEETRASSGVIWNSFKELEESELETVKREIPAPSFLLPLPKHYRAESSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5777 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcttgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcagacgcgcgtatagcaattggcaggatgctaaagaaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtcgcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaacgggcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5778 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIRRAYSNWQDAKEILDKMIEETRASSGVIWNSFKELEESELETVKREIPAPSFLLPLPKHYRAESSSLLDEDPSVFQWLDQQPPSSVLYVGFGTQSEVDEKDFLEIARGLVDSKQSFLWRVRPGFVKGREWVEPLPDGFLGERGRIVKSCPQQEVLAHDAIGAFWTHGGWNGTMEGVAEGVPMIFSDFGLDQPLNARYMSDVLKVGVYLENGLERGEIERAIRRVMVDREGEVMRQNAAKLKDKADVSLAKGGSSYESLESLVSYISSL

SEQ ID NO: 5779 - DNA, 1371 bp, Artificial Sequence
  "Variant of ADP-beta-1,3-glucosyltransferase"
atgaataacaaaaccgaaccgaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaggcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaacgggcgattaggcgtgtgatggttgaccgtgaaggtgaggtgatgcgtcaaaacgcggccagactgaaggataaagcggatgtgagcctggctaagggtggcagcagctacgagagcctggaaagcctggttagctatattagcagcctg

SEQ ID NO: 5780 - protein, 457 aa, Artificial Sequence
  "Variant of ADP-beta-1,3-glucosyltransferase"
MNNKTEPTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVKREIPAPSFLLPLPKHYRAEGSSLLDEDPSVFQWLDQQPPSSVLYVGFGTQSEVDEKDFLEIARGLVDSKQSFLWRVRPGFVKGSEWIEPLPDGFLGERGRIVKSCPQQEVLAHDAIGAFWTHGGWNGTMEGVAEGVPMIFSDFGLDQPLNARYMSDVLKVGVYLENGLERGEIERAIRRVMVDREGEVMRQNAARLKDKADVSLAKGGSSYESLESLVSYISSL

SEQ ID NO: 5781 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggctcacgattcgattggtgcgttctggacccacggcggttggaacggcaccatggagggcgtggcggaaggcgttccgatgatctttcgcgatttcggtctggatcagccgctgaacgcgcgttacatgagcgatgttctgaaagtgggcgtttatctggaaaacggcttggagcgtggtgaaatcgaaaacgcgattaggcgtgtgatggttgaccgtgaaggtgaggtgatgcgtcaaaacgcggcgaaactgaaggataaagcggataggagcctggctaagggtggcagcagctacgagagcctggaaagcctggttagctatattagcagcctg

SEQ ID NO: 5782 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDSIGAFWTHGGWNGTMEGVAEGVPMIFRDFGLDQPLNARYMSDVLKVGVYLENGLERGEIENAIRRVMVDREGEVMRQNAAKLKDKADRSLAKGGSSYESLESLVSYISSL

SEQ ID NO: 5783 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttcgcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5784 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFRDFGLDQPLNARYMSDVLKVGVYLENGLERGEIENAIRRVMVDREGEVMRQNAAKLKDKADVSLAKGGSSYESLESLVSYISSL

SEQ ID NO: 5785 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcgcttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5786 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSAYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5787 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccgttctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5788 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTVLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5789 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcaggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5790 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWQVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5791 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgcagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5792 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVQSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5793 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggaggcggtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5794 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEAVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5795 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaatgggtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5796 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQWVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5797 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggctctcagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5798 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVWREIPAPSFLLPLPKHYRASSSSLLDEDPSVFQWLDQQPPSSVLYVGFGSQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5799 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggttggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5800 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWLVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5801 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagagtgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5802 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMESVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5803 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatctgtaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5804 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEICNAIRRVMVDREGEVMRQNAAKLKDKADVSLAKGGSSYESLESLVSYISSL

SEQ ID NO: 5805 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgtttgtaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5806 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVCKVGVYLENGLERGEIENAIRRVMVDREGEVMRQNAAKLKDKADVSLAKGGSSYESLESLVSYISSL

SEQ ID NO: 5807 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgttaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5808 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIVNAIRRVMVDREGEVMRQNAAKLKDKADVSLAKGGSSYESLESLVSYISSL

SEQ ID NO: 5809 - DNA, 1371 bp, Artificial Sequence
  "Variant of ADP-beta-1,3-glucosyltransferase"
atggagaacaaaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5810 - protein, 457 aa, Artificial Sequence
  "Variant of ADP-beta-1,3-glucosyltransferase"
MENKTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5811 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcctgctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatgtgagcctggctaagggtggcagcagctacgagagcctggaaagcctggttagctatattagcagcctg

SEQ ID NO: 5812 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVWREIPAPSFLLPLPKHYRASSSLLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVMRQNAAKLKDKADVSLAKGGSSYESLESLVSYISSL

SEQ ID NO: 5813 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccgggtgataaaacccgtctggaggaaccggtggtaggtttcccgatgctgaaggttaaagatatcaaacgcgcgtatagcaattggcaggatgctaaagaaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtgttccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacgatgcgattggtgcgttctggacccacggcggttggaacggcaccatggagggcgtggcggaaggcgttccgatgatctttagcgatttcggtctggatcagccgctgaacgcgcgttacatgagcgatgttctgaaagtgggcgtttatctggagaacggcttggagcgtggtgaaatcgaaaacgcgattaggcgtgtgatggttgaccgtgaaggtgaggtgcagcgtcaaaacgcggcgaaactgaaggataaagcggatgtgagcctggctaagggtggcagcagctacgagagcctggaaagcctggttagctatattagcagcctg

SEQ ID NO: 5814 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPGDKTRLEEPVVGFPMLKVKDIKRAYSNWQDAKEILDKMIEETRASSGVIWNSFKELEESELETVWREIPAPSFLLPLPKHYRASSSSLLDEDPSVFQWLDQQPPSSVLYVGFGTQSEVDEKDFLEIARGLVDSKQSFLWRVRPGFVKGSEWVEPLPDGFLGERGRIVKSCPQQEVLAHDAIGAFWTHGGWNGTMEGVAEGVPMIFSDFGLDQPLNARYMSDVLKVGVYLENGLERGEIENAIRRVMVDREGEVQRQNAAKLKDKADVSLAKGGSSYESLESLVSYISSL

SEQ ID NO: 5815 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacataacctggaggaaccggtggtaggtttcccgatgctgaaggttaaagatatcagacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcggaaagcagcagcctggcagacgaagatccgagcgtggcccaatggctggatcagcaaccgccgagcagcgtgctgtacgttggctttggcacccagagcgaagtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacggcgcgattggtgcgttctggacccacggcggttggaacggcaccatggagggcgtggcggaaggcgttccgatgatcttttccgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcgcggaaactgaaggataaagcggatcgaagcattgctaagggtggcagcagctacgagagcctggaaagcctggttagctatattagcagcctg

SEQ ID NO: 5816 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHNLEEPVVGFPMLKVKDIRRAYSNWQDAKPILDKMIEETRASSGVIWNSFKELEESELETVWREIPAPSFLLPLPKHYRAESSSLADEDPSVAQWLDQQPPSSVLYVGFGTQSEVDEKDFLEIARGLVDSKQSFLWRVRPGFVKGSEWVEPLPDGFLGERGRIVKSCPQQEVLAHGAIGAFWTHGGWNGTMEGVAEGVPMIFSDFGLDQPLNARYMSDVLHVGVYLENGLERGEIENAIRRVMVDREGEVMRQNARKLKDKADRSIAKGGSSYESLESLVSYISSL

SEQ ID NO: 5817 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacataacctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattcggcgtgtgatggttgaccgtgaaggtgaggtgatgcgtcaaaacgcggcgaaactgaaggataaagcggatcgaagccttgctaagggtggcagcagctacgagagcctggaaagcctggttagctatattagcagcctg

SEQ ID NO: 5818 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHNLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 5819 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaagcagcagcctgctagacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcgttgctaagggtggcagcagctacgagagcctggaaagcctggttagctatattagcagcctg

SEQ ID NO: 5820 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVKREIPAPSFLLPLPKHYRAESSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSVAKGGSSYESLESLVSYISSL

SEQ ID NO: 5821 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacataacctggaggaaccggtggtaggtttcccgatgctgaaggttaaagatatcagacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgtccagcagcagcctggcagacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattcggcgtgtgatggttgaccgtgaaggtgaggtgatgcgtcaaaacgcgcggaaactgaaggataaagcggatcgaagcattgctaagggtggcagcagctacgagagcctggaaagcctggttagctatattagcagcctg

SEQ ID NO: 5822 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHNLEEPVVGFPMLKVKDIRRAYSNWQDAKPILDKMIEETRASSGVIWNSFKELEESELETVWREIPAPSFLLPLPKHYRASSSSLADEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNARKLKDKADRSIAKGGSSYESLESLVSYISSL

SEQ ID NO: 5823 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacggcgcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattcagcgtgtgatggttgaccgtgaaggtgaggtgatgcgtcaaaacgcggcgaaactgaaggataaagcggatcgaagcattgctaagggtggcagcagctacgagagcctggaaagcctggttagctatattagcagcctg

SEQ ID NO: 5824 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHGAIGAFWTHGGWNGTMEGVAEGVPMIFSDFGLDQPLNARYMSDVLHVGVYLENGLERGEIENAIQRVMVDREGEVMRQNAAKLKDKADRSIAKGGSSYESLESLVSYISSL

SEQ ID NO: 5825 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatagactggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaagcagcagcctgctagacgaagatccgagcgtggcccaatggctggaccagcaaccgccgagcagcgtgctgtacgttggctttggcacccagagccaagtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatcttttccgatttcggtctggatcagccgctgaacgcgcgttacatgagcgatgttctgcatgtgggcgtttatctggagaacggcttggagcgtggtgaaatcgaaaacgcgattcggcgtgtgatggttgaccgtgaaggtgaggtgatgcgtcaaaacgcggcgaaactgaaggataaagcggatcgaagcgttgctaagggtggcagcagctacgagagcctggaaagcctggttagctatattagcagcctg

SEQ ID NO: 5826 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVKREIPAPSFLLPLPKHYRAESSSLLDEDPSVAQWLDQQPPSSVLYVGFGTQSQVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSVAKGGSSYESLESLVSYISSL

SEQ ID NO: 5827 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacataacctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcggaaagcagcagcctgctagacgaagatccgagcgtggcccaatggctggaccagcaaccgccgagcagcgtgctgtacgttggctttggcactcagagcgaagtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattcggcgtgtgatggttgaccgtgaaggtgaggtgatgcgtcaaaacgcggcgaaactgaaggataaagcggatcgaagccttgctaagggtggcagcagctacgagagcctggaaagcctggttagctatattagcagcctg

SEQ ID NO: 5828 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHNLEEPVVGFPMLKVKDIKRAYSNWQDAKPILDKMIEETRASSGVIWNSFKELEESELETVWREIPAPSFLLPLPKHYRAESSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 5829 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagccaagtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacggcgcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcgttgctaagggtggcagcagctacgagagcctggaaagcctggttagctatattagcagcctg

SEQ ID NO: 5830 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSQVDEKDFLEIARGLVDSKQSFLWRVRPGFVKGSEWVEPLPDGFLGERGRIVKSCPQQEVLAHGAIGAFWTHGGWNGTMEGVAEGVPMIFSDFGLDQPLNARYMSDVLHVGVYLENGLERGEIENAIRRVMVDREGEVMRQNAAKLKDKADRSVAKGGSSYESLESLVSYISSL

SEQ ID NO: 5831 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacataacctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcggaaagcagcagcctgctagacgaagatccgagcgtggcccaatggctgcatcagcaaccgccgagcagcgtgctgtacgttggctttggcacccagagcgaagtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatcttttccgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcgttgctaagggtggcagcagctacgagagcctggaaagcctggttagctatattagcagcctg

SEQ ID NO: 5832 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHNLEEPVVGFPMLKVKDIKRAYSNWQDAKPILDKMIEETRASSGVIWNSFKELEESELETVWREIPAPSFLLPLPKHYRAESSSLLDEDPSVAQWLHQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSVAKGGSSYESLESLVSYISSL

SEQ ID NO: 5833 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatagactggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgtccagcagcagcctggcagacgaagatccgagcgtggcccaatggctggaccagcaaccgccgagcagcgtgctgtacgttggctttggcacccagagcgaagtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacggcgcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattcagcgtgtgatggttgaccgtgaaggtgaggtgatgcgtcaaaacgcggcgaaactgaaggataaagcggatcgaagcgttgctaagggtggcagcagctacgagagcctggaaagcctggttagctatattagcagcctg

SEQ ID NO: 5834 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVWREIPAPSFLLPLPKHYRASSSSLADEDPSVAQWLDQQPPSSVLYVGFGTQSEVDEKDFLEIARGLVDSKQSFLWRVRPGFVKGSEWVEPLPDGFLGERGRIVKSCPQQEVLAHGAIGAFWTHGGWNGTMEGVAEGVPMIFSDFGLDQPLNARYMSDVLHVGVYLENGLERGEIENAIQRVMVDREGEVMRQNAAKLKDKADRSVAKGGSSYESLESLVSYISSL

SEQ ID NO: 5835 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcggaaagcagcagcctggcagacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacggcgcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcgttgctaagggtggcagcagctacgagagcctggaaagcctggttagctatattagcagcctg

SEQ ID NO: 5836 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVWREIPAPSFLLPLPKHYRAESSSLADEDPSVAQWLDQQPPSSVLYVGFGTQSEVDEKDFLEIARGLVDSKQSFLWRVRPGFVKGSEWVEPLPDGFLGERGRIVKSCPQQEVLAHGAIGAFWTHGGWNGTMEGVAEGVPMIFSDFGLDQPLNARYMSDVLHVGVYLENGLERGEIENAIRRVMVDREGEVMRQNAAKLKDKADRSVAKGGSSYESLESLVSYISSL

SEQ ID NO: 5837 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacataacctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcggaaagcagcagcctgctagacgaagatccgagcgtggcccaatggctggatcagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacggcgcgattggtgcgttctggacccacggcggttggaacggcaccatggagggcgtggcggaaggcgttccgatgatcttttccgatttcggtctggatcagccgctgaacgcgcgttacatgagcgatgttctgcatgtgggcgtttatctggagaacggcttggagcgtggtgaaatcgaaaacgcgattcagcgtgtgatggttgaccgtgaaggtgaggtgatgcgtcaaaacgcggcgaaactgaaggataaagcggatcgaagccttgctaagggtggcagcagctacgagagcctggaaagcctggttagctatattagcagcctg

SEQ ID NO: 5838 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHNLEEPVVGFPMLKVKDIKRAYSNWQDAKPILDKMIEETRASSGVIWNSFKELEESELETVWREIPAPSFLLPLPKHYRAESSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHGAIGAFWTHGGWNGTMEGVAEGVPMIFSDFGLDQPLNARYMSDVLHVGVYLENGLERGEIENAIQRVMVDREGEVMRQNAAKLKDKADRSLAKGGSSYESLESLVSYISSL

SEQ ID NO: 5839 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatagactggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaagcagcagcctgctagacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattcggcgtgtgatggttgaccgtgaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 5840 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVKREIPAPSFLLPLPKHYRAESSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 5841 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacataacctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaagcagcagcctggcagacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattcggcgtgtgatggttgaccgtgaaggtgaggtgatgcgtcaaaacgcgcggaaactgaaggataaagcggatcgaagccttgctaagggtggcagcagctacgagagcctggaaagcctggttagctatattagcagcctg

SEQ ID NO: 5842 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHNLEEPVVGFPMLKVKDIKRAYSNWQDAKPILDKMIEETRASSGVIWNSFKELEESELETVKREIPAPSFLLPLPKHYRAESSSLADEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNARKLKDKADRSLAKGGSSYESLESLVSYISSL

SEQ ID NO: 5843 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaagcagcagcctggcagacgaagatccgagcgtggcccaatggctggatcagcaaccgccgagcagcgtgctgtacgttggctttggcacccagagcgaagtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcgcggaaactgaaggataaagcggatcgaagcgttgctaagggtggcagcagctacgagagcctggaaagcctggttagctatattagcagcctg

SEQ ID NO: 5844 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVKREIPAPSFLLPLPKHYRAESSSLADEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNARKLKDKADRSVAKGGSSYESLESLVSYISSL

SEQ ID NO: 5845 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatagactggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaagcagcagcctgctagacgaagatccgagcgtggcccaatggctggatcagcaaccgccgagcagcgtgctgtacgttggctttggcacccagagcgaagtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatcttttccgatttcggtctggatcagccgctgaacgcgcgttacatgagcgatgttctgcatgtgggcgtttatctggagaacggcttggagcgtggtgaaatcgaaaacgcgattcagcgtgtgatggttgaccgtgaaggtgaggtgatgcgtcaaaacgcggcgaaactgaaggataaagcggatcgaagcgttgctaagggtggcagcagctacgagagcctggaaagcctggttagctatattagcagcctg

SEQ ID NO: 5846 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVKREIPAPSFLLPLPKHYRAESSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIQRVMVDREGEVMRQNAAKLKDKADRSVAKGGSSYESLESLVSYISSL

SEQ ID NO: 5847 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacataacctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctggcagacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttaaagatttcggtctggatcagccgctgaacgcgcgttacatgagcgatgttctgcatgtgggcgtttatctggagaacggcttggagcgtggtgaaatcgaaaacgcgattcggcgtgtgatggttgaccgtgaaggtgaggtgatgcgtcaaaacgcggcgaaactgaaggataaagcggatcgaagcgttgctaagggtggcagcagctacgagagcctggaaagcctggttagctatattagcagcctg

SEQ ID NO: 5848 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHNLEEPVVGFPMLKVKDIKRAYSNWQDAKPILDKMIEETRASSGVIWNSFKELEESELETVWREIPAPSFLLPLPKHYRASSSSLADEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFKDFGLDQPLNARYMSDVLHVGVYLENGLERGEIENAIRRVMVDREGEVMRQNAAKLKDKADRSVAKGGSSYESLESLVSYISSL

SEQ ID NO: 5849 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcagacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcggaaagcagcagcctggcagacgaagatccgagcgtggcccaatggctggaccagcaaccgccgagcagcgtgctgtacgttggctttggcacccagagcgaagtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattcagcgtgtgatggttgaccgtgaaggtgaggtgatgcgtcaaaacgcggcgaaactgaaggataaagcggatcgaagcattgctaagggtggcagcagctacgagagcctggaaagcctggttagctatattagcagcctg

SEQ ID NO: 5850 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIRRAYSNWQDAKPILDKMIEETRASSGVIWNSFKELEESELETVWREIPAPSFLLPLPKHYRAESSSLADEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIQRVMVDREGEVMRQNAAKLKDKADRSIAKGGSSYESLESLVSYISSL

SEQ ID NO: 5851 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacataacctggaggaaccggtggtaggtttcccgatgctgaaggttaaagatatcagacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgtccagcagcagcctggcagacgaagatccgagcgtggcccaatggctggaccagcaaccgccgagcagcgtgctgtacgttggctttggcacccagagcgaagtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttaaagatttcggtctggatcagccgctgaacgcgcgttacatgagcgatgttctgcatgtgggcgtttatctggagaacggcttggagcgtggtgaaatcgaaaacgcgattcggcgtgtgatggttgaccgtgaaggtgaggtgatgcgtcaaaacgcggcgaaactgaaggataaagcggatcgaagcgttgctaagggtggcagcagctacgagagcctggaaagcctggttagctatattagcagcctg

SEQ ID NO: 5852 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHNLEEPVVGFPMLKVKDIRRAYSNWQDAKPILDKMIEETRASSGVIWNSFKELEESELETVWREIPAPSFLLPLPKHYRASSSSLADEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFKDFGLDQPLNARYMSDVLHVGVYLENGLERGEIENAIRRVMVDREGEVMRQNAAKLKDKADRSVAKGGSSYESLESLVSYISSL

SEQ ID NO: 5853 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatagactggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcgtccagcagcagcctgctagacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttaaagatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcattgctaagggtggcagcagctacgagagcctggaaagcctggttagctatattagcagcctg

SEQ ID NO: 5854 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVKREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFKDFGLDQPLNARYMSDVLHVGVYLENGLERGEIENAIRRVMVDREGEVMRQNAAKLKDKADRSIAKGGSSYESLESLVSYISSL

SEQ ID NO: 5855 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggatcagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacggcgcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcgcggaaactgaaggataaagcggatcgaagcgttgctaagggtggcagcagctacgagagcctggaaagcctggttagctatattagcagcctg

SEQ ID NO: 5856 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHGAIGAFWTHGGWNGTMEGVAEGVPMIFSDFGLDQPLNARYMSDVLHVGVYLENGLERGEIENAIRRVMVDREGEVMRQNARKLKDKADRSVAKGGSSYESLESLVSYISSL

SEQ ID NO: 5857 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatagactggaggaaccggtggtaggtttcccgatgctgaaggttaaagatatcagacgcgcgtatagcaattggcaggatgctaaaccaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaagcagcagcctggcagacgaagatccgagcgtggcccaatggctggaccagcaaccgccgagcagcgtgctgtacgttggctttggcacccagagcgaagtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacggcgcgattggtgcgttctggacccacggcggttggaacggcaccatggagggcgtggcggaaggcgttccgatgatcttttccgatttcggtctggatcagccgctgaacgcgcgttacatgagcgatgttctgcatgtgggcgtttatctggagaacggcttggagcgtggtgaaatcgaaaacgcgattcagcgtgtgatggttgaccgtgaaggtgaggtgatgcgtcaaaacgcggcgaaactgaaggataaagcggatcgaagcattgctaagggtggcagcagctacgagagcctggaaagcctggttagctatattagcagcctg

SEQ ID NO: 5858 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIRRAYSNWQDAKPILDKMIEETRASSGVIWNSFKELEESELETVKREIPAPSFLLPLPKHYRAESSSLADEDPSVAQWLDQQPPSSVLYVGFGTQSEVDEKDFLEIARGLVDSKQSFLWRVRPGFVKGSEWVEPLPDGFLGERGRIVKSCPQQEVLAHGAIGAFWTHGGWNGTMEGVAEGVPMIFSDFGLDQPLNARYMSDVLHVGVYLENGLERGEIENAIQRVMVDREGEVMRQNAAKLKDKADRSIAKGGSSYESLESLVSYISSL

SEQ ID NO: 5859 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatagactggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaagcagcagcctggcagacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacggcgcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 5860 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVKREIPAPSFLLPLPKHYRAESSSLADEDPSVAQWLDQQPPSSVLYVGFGTQSEVDEKDFLEIARGLVDSKQSFLWRVRPGFVKGSEWVEPLPDGFLGERGRIVKSCPQQEVLAHGAIGAFWTHGGWNGTMEGVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 5861 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaagcagcagcctggcagacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacggcgcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattcagcgtgtgatggttgaccgtgaaggtgaggtgatgcgtcaaaacgcggcgaaactgaaggataaagcggatcgaagcattgctaagggtggcagcagctacgagagcctggaaagcctggttagctatattagcagcctg

SEQ ID NO: 5862 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVKREIPAPSFLLPLPKHYRAESSSLADEDPSVAQWLDQQPPSSVLYVGFGTQSEVDEKDFLEIARGLVDSKQSFLWRVRPGFVKGSEWVEPLPDGFLGERGRIVKSCPQQEVLAHGAIGAFWTHGGWNGTMEGVAEGVPMIFSDFGLDQPLNARYMSDVLHVGVYLENGLERGEIENAIQRVMVDREGEVMRQNAAKLKDKADRSIAKGGSSYESLESLVSYISSL

SEQ ID NO: 5863 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatagactggaggaaccggtggtaggtttcccgatgctgaaggttaaagatatcagacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcggaaagcagcagcctggcagacgaagatccgagcgtggcccaatggctggaccagcaaccgccgagcagcgtgctgtacgttggctttggcacccagagccaagtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattcggcgtgtgatggttgaccgtgaaggtgaggtgatgcgtcaaaacgcgcggaaactgaaggataaagcggatcgaagccttgctaagggtggcagcagctacgagagcctggaaagcctggttagctatattagcagcctg

SEQ ID NO: 5864 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIRRAYSNWQDAKPILDKMIEETRASSGVIWNSFKELEESELETVWREIPAPSFLLPLPKHYRAESSSLADEDPSVAQWLDQQPPSSVLYVGFGTQSQVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNARKLKDKADRSLAKGGSSYESLESLVSYISSL

SEQ ID NO: 5865 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacataacctggaggaaccggtggtaggtttcccgatgctgaaggttaaagatatcagacgcgcgtatagcaattggcaggatgctaaaccaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaagcagcagcctgctagacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattcggcgtgtgatggttgaccgtgaaggtgaggtgatgcgtcaaaacgcgcggaaactgaaggataaagcggatcgaagcgttgctaagggtggcagcagctacgagagcctggaaagcctggttagctatattagcagcctg

SEQ ID NO: 5866 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHNLEEPVVGFPMLKVKDIRRAYSNWQDAKPILDKMIEETRASSGVIWNSFKELEESELETVKREIPAPSFLLPLPKHYRAESSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNARKLKDKADRSVAKGGSSYESLESLVSYISSL

SEQ ID NO: 5867 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttaaagatttcggtctggatcagccgctgaacgcgcgttacatgagcgatgttctgcatgtgggcgtttatctggagaacggcttggagcgtggtgaaatcgaaaacgcgattcagcgtgtgatggttgaccgtgaaggtgaggtgatgcgtcaaaacgcggcgaaactgaaggataaagcggatcgaagcgttgctaagggtggcagcagctacgagagcctggaaagcctggttagctatattagcagcctg

SEQ ID NO: 5868 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFKDFGLDQPLNARYMSDVLHVGVYLENGLERGEIENAIQRVMVDREGEVMRQNAAKLKDKADRSVAKGGSSYESLESLVSYISSL

SEQ ID NO: 5869 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacataacctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattcggcgtgtgatggttgaccgtgaaggtgaggtgatgcgtcaaaacgcggcgaaactgaaggataaagcggatcgaagcattgctaagggtggcagcagctacgagagcctggaaagcctggttagctatattagcagcctg

SEQ ID NO: 5870 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHNLEEPVVGFPMLKVKDIKRAYSNWQDAKPILDKMIEETRASSGVIWNSFKELEESELETVKREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSIAKGGSSYESLESLVSYISSL

SEQ ID NO: 5871 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacataacctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgtccagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgttggcgtttatctggagaacggcttggagcgtggtgaaatcgaaaacgcgattaggcgtgtgatggttgaccgtgaaggtgaggtgatgcgtcaaaacgcgcggaaactgaaggataaagcggatcgaagcattgctaagggtggcagcagctacgagagcctggaaagcctggttagctatattagcagcctg

SEQ ID NO: 5872 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHNLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNARKLKDKADRSIAKGGSSYESLESLVSYISSL

SEQ ID NO: 5873 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttaaagatttcggtctggatcagccgctgaacgcgcgttacatgagcgatgttctgcatgtgggcgtttatctggagaacggcttggagcgtggtgaaatcgaaaacgcgattcagcgtgtgatggttgaccgtgaaggtgaggtgatgcgtcaaaacgcggcgaaactgaaggataaagcggatcgaagcattgctaagggtggcagcagctacgagagcctggaaagcctggttagctatattagcagcctg

SEQ ID NO: 5874 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFKDFGLDQPLNARYMSDVLHVGVYLENGLERGEIENAIQRVMVDREGEVMRQNAAKLKDKADRSIAKGGSSYESLESLVSYISSL

SEQ ID NO: 5875 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatagactggaggaaccggtggtaggtttcccgatgctgaaggttaaagatatcagacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcggaaagcagcagcctgctagacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 5876 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIRRAYSNWQDAKPILDKMIEETRASSGVIWNSFKELEESELETVWREIPAPSFLLPLPKHYRAESSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 5877 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatagactggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcggaaagcagcagcctggcagacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 5878 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVWREIPAPSFLLPLPKHYRAESSSLADEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 5879 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcgagcagcagcagcctgctagacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttaaagatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 5880 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVKREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFKDFGLDQPLNARYMSDVLHVGVYLENGLERGEIENAIRRVMVDREGEVMRQNAAKLKDKADRSLAKGGSSYESLESLVSYISSL

SEQ ID NO: 5881 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgtccagcagcagcctgctagacgaagatccgagcgtggcccaatggctggatcagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattcagcgtgtgatggttgaccgtgaaggtgaggtgatgcgtcaaaacgcggcgaaactgaaggataaagcggatcgaagcgttgctaagggtggcagcagctacgagagcctggaaagcctggttagctatattagcagcctg

SEQ ID NO: 5882 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIQRVMVDREGEVMRQNAAKLKDKADRSVAKGGSSYESLESLVSYISSL

SEQ ID NO: 5883 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttaaagatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 5884 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFKDFGLDQPLNARYMSDVLHVGVYLENGLERGEIENAIRRVMVDREGEVMRQNAAKLKDKADRSLAKGGSSYESLESLVSYISSL

SEQ ID NO: 5885 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatagactggaggaaccggtggtaggtttcccgatgctgaaggttaaagatatcagacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggatcagcaaccgccgagcagcgtgctgtacgttggctttggcacccagagcgaagtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttaaagatttcggtctggatcagccgctgaacgcgcgttacatgagcgatgttctgcatgtgggcgtttatctggagaacggcttggagcgtggtgaaatcgaaaacgcgattcggcgtgtgatggttgaccgtgaaggtgaggtgatgcgtcaaaacgcgcggaaactgaaggataaagcggatcgaagcgttgctaagggtggcagcagctacgagagcctggaaagcctggttagctatattagcagcctg

SEQ ID NO: 5886 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIRRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFKDFGLDQPLNARYMSDVLHVGVYLENGLERGEIENAIRRVMVDREGEVMRQNARKLKDKADRSVAKGGSSYESLESLVSYISSL

SEQ ID NO: 5887 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatcttttccgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcattgctaagggtggcagcagctacgagagcctggaaagcctggttagctatattagcagcctg

SEQ ID NO: 5888 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSIAKGGSSYESLESLVSYISSL

SEQ ID NO: 5889 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacataacctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgtccagcagcagcctgctagacgaagatccgagcgtggcccaatggctggatcagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttaaagatttcggtctggatcagccgctgaacgcgcgttacatgagcgatgttctgcatgtgggcgtttatctggagaacggcttggagcgtggtgaaatcgaaaacgcgattcggcgtgtgatggttgaccgtgaaggtgaggtgatgcgtcaaaacgcggcgaaactgaaggataaagcggatcgaagcattgctaagggtggcagcagctacgagagcctggaaagcctggttagctatattagcagcctg

SEQ ID NO: 5890 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHNLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFKDFGLDQPLNARYMSDVLHVGVYLENGLERGEIENAIRRVMVDREGEVMRQNAAKLKDKADRSIAKGGSSYESLESLVSYISSL

SEQ ID NO: 5891 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatagactggaggaaccggtggtaggtttcccgatgctgaaggttaaagatatcagacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcggaaagcagcagcctggcagacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcgcggaaactgaaggataaagcggatcgaagccttgctaagggtggcagcagctacgagagcctggaaagcctggttagctatattagcagcctg

SEQ ID NO: 5892 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIRRAYSNWQDAKPILDKMIEETRASSGVIWNSFKELEESELETVWREIPAPSFLLPLPKHYRAESSSLADEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNARKLKDKADRSLAKGGSSYESLESLVSYISSL

SEQ ID NO: 5893 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatagactggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaagcagcagcctggcagacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattcggcgtgtgatggttgaccgtgaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 5894 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVKREIPAPSFLLPLPKHYRAESSSLADEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 5895 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatagactggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgttaagcgtgaaattccggcgccgagcttcctgcttccgctgccgaagcactatagggcggaaagcagcagcctgctagacgaagatccgagcgtggcccaatggctggatcagcaaccgccgagcagcgtgctgtacgttggctttggcacccagagccaagtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattcggcgtgtgatggttgaccgtgaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 5896 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVKREIPAPSFLLPLPKHYRAESSSLLDEDPSVAQWLDQQPPSSVLYVGFGTQSQVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 5897 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccacagtttttagaggcgggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgcaggacgaagatccgagcgtggcccaatggctggaccagcaaccgccgagcagcgtgctgtacgttggctttggcacccagagcgaggtggacgaaaaagatttcctggagattgcgcgtggtctggttgacagcagacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagagcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctacattagcagcctg

SEQ ID NO: 5898 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLEAGYLDPEDKHRLEEPVVGFPMLKVKDIKRAYSNWQDAKPILDKMIEETRASSGVIWNSFKELEESELETVWREIPAPSFLLPLPKHYRASSSSLQDEDPSVAQWLDQQPPSSVLYVGFGTQSEVDEKDFLEIARGLVDSRQSFLWRVRPGFVKGSEWVEPLPDGFLGERGRIVKSCPQQEVLAHKAIGAFWTHGGWNGTMESVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 5899 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcagacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagagcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 5900 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSRQSFLWRVRPGFVKGSEWVEPLPDGFLGERGRIVKSCPQQEVLAHKAIGAFWTHGGWNGTMESVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 5901 - DNA, 1371 bp, Artificial Sequence
  "Variant of ADP-beta-1,3-glucosyltransferase"
atgcccaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggaccagtttttagaggcgggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagagcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaacgcctggttagctacattagcagcctg

SEQ ID NO: 5902 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLDQFLEAGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMESVAEGVPMIFSDFGLDQPLNARYMSDVLHVGVYLENGLERGEIENAIRRVMVDREGEVMRQNAAKLKDKADRSLAKGGSSYESLERLVSYISSL

SEQ ID NO: 5903 - DNA, 1371 bp, Artificial Sequence
  "Variant of ADP-beta-1,3-glucosyltransferase"
atgcccaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggaccagtttttagagcgaggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctacattagcagcctg

SEQ ID NO: 5904 - protein, 457 aa, Artificial Sequence
  "Variant of ADP-beta-1,3-glucosyltransferase"
MPNKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLDQFLERGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 5905 - DNA, 1371 bp, Artificial Sequence
  "Variant of ADP-beta-1,3-glucosyltransferase"
atgcccaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccacagtttttagagcgaggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagagcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagccgaattagcagcctg

SEQ ID NO: 5906 - protein, 457 aa, Artificial Sequence
  "Variant of ADP-beta-1,3-glucosyltransferase"
MPNKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLERGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMESVAEGVPMIFSDFGLDQPLNARYMSDVLHVGVYLENGLERGEIENAIRRVMVDREGEVMRQNAAKLKDKADRSLAKGGSSYESLESLVSRISSL

SEQ ID NO: 5907 - DNA, 1371 bp, Artificial Sequence
  "Variant of ADP-beta-1,3-glucosyltransferase"
atgcccaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccacagtttttagaggcgggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgcaggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctacattagcagcctg

SEQ ID NO: 5908 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLEAGYLDPEDKHRLEEPVVGFPMLKVKDIKRAYSNWQDAKPILDKMIEETRASSGVIWNSFKELEESELETVWREIPAPSFLLPLPKHYRASSSSLQDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 5909 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagagcgtggcggaaggcgttccgatgatctttagcgatttcggtctggatcagccgctgaacgcgcgttacatgagcgatgttctgcatgtgggcgtttatctggaggacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctacattagcagcctg

SEQ ID NO: 5910 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMESVAEGVPMIFSDFGLDQPLNARYMSDVLHVGVYLEDGLERGEIENAIRRVMVDREGEVMRQNAAKLKDKADRSLAKGGSSYESLESLVSYISSL

SEQ ID NO: 5911 - DNA, 1371 bp, Artificial Sequence
  "Variant of ADP-beta-1,3-glucosyltransferase"
atgcccaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccacagtttttagaggcgggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagagcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagccgaattagcagcctg

SEQ ID NO: 5912 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLEAGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMESVAEGVPMIFSDFGLDQPLNARYMSDVLHVGVYLENGLERGEIENAIRRVMVDREGEVMRQNAAKLKDKADRSLAKGGSSYESLESLVSRISSL

SEQ ID NO: 5913 - DNA, 1371 bp, Artificial Sequence
  "Variant of ADP-beta-1,3-glucosyltransferase"
atgcccaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccacagtttttagaggcgggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgatcgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaacgcctggttagctacattagcagcctg

SEQ ID NO: 5914 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLEAGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGDRGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSLAKGGSSYESLERLVSYISSL

SEQ ID NO: 5915 - DNA, 1371 bp, Artificial Sequence
  "Variant of ADP-beta-1,3-glucosyltransferase"
atggaaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccgtcagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggaccagtttttagagctaggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcagacaaagctttctgtggcgggttcgtccgggcttcgtgaagggtagcgagtgggttgagccgctgccggatggttttctgggcgatcgtggtcgtatcgtgaagtcttgcccgcaacaagaagtgctggcgcacaaggcgattggtgcgttctggacccacggcggttggaacggcaccatggagagcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctacattagcagcctg

SEQ ID NO: 5916 - protein, 457 aa, Artificial Sequence
  "Variant of ADP-beta-1,3-glucosyltransferase"
MENTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPSDEEVACLITDALWYFAQPVADSLNLPRLVLMTSSLFNFHALVSLDQFLELGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSRQSFLWRVRPGFVKGSEWVEPLPDGFLGDRGRIVKSCPQQEVLAHKAIGAFWTHGGWNGTMESVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 5917 - DNA, 1371 bp, Artificial Sequence
  "Variant of ADP-beta-1,3-glucosyltransferase"
atgcccaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccgtcagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaacgcctggttagctacattagcagcctg

SEQ ID NO: 5918 - protein, 457 aa, Artificial Sequence
  "Variant of ADP-beta-1,3-glucosyltransferase"
MPNKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPSDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSLAKGGSSYESLERLVSYISSL

SEQ ID NO: 5919 - DNA, 1371 bp, Artificial Sequence
  "Variant of ADP-beta-1,3-glucosyltransferase"
atgcccaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccacagtttttagagctaggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcagacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 5920 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSRQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 5921 - DNA, 1371 bp, Artificial Sequence
  "Variant of ADP-beta-1,3-glucosyltransferase"
atggaaaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcgaggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcagacaaagctttctgtggcgggttcgtccgggcttcgtgaagggtagcgagtgggttgagccgctgccggatggttttctgggcgatcgtggtcgtatcgtgaagtcttgcccgcaacaagaagtgctggcgcacaaggcgattggtgcgttctggacccacggcggttggaacggcaccatggagagcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaacgcctggttagctacattagcagcctg

SEQ ID NO: 5922 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLERGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSRQSFLWRVRPGFVKGSEWVEPLPDGFLGDRGRIVKSCPQQEVLAHKAIGAFWTHGGWNGTMESVAEGVPMIFSDFGLDQPLNARYMSDVLHVGVYLENGLERGEIENAIRRVMVDREGEVMRQNAAKLKDKADRSLAKGGSSYESLERLVSYISSL

SEQ ID NO: 5923 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccacagtttttagagcttggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgatcgtggtcgtatcgtgaagtcttgcccgcaacaagaagtgctggcgcacaaggcgattggtgcgttctggacccacggcggttggaacggcaccatggagagcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 5924 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGDRGRIVKSCPQQEVLAHKAIGAFWTHGGWNGTMESVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 5925 - DNA, 1371 bp, Artificial Sequence
  "Variant of ADP-beta-1,3-glucosyltransferase"
atgcccaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccgtcagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggaccagtttttagaggcgggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgatcgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaacgcctggttagctacattagcagcctg

SEQ ID NO: 5926 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPSDEEVACLITDALWYFAQPVADSLNLPRLVLMTSSLFNFHALVSLDQFLEAGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGDRGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSLAKGGSSYESLERLVSYISSL

SEQ ID NO: 5927 - DNA, 1371 bp, Artificial Sequence
  "Variant of ADP-beta-1,3-glucosyltransferase"
atgcccaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggaccagtttttagaggcgggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagagcgtggcggaaggcgttccgatgatctttagcgatttcggtctggatcagccgctgaacgcgcgttacatgagcgatgttctgcatgtgggcgtttatctggaggacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 5928 - protein, 457 aa, Artificial Sequence
  "Variant of ADP-beta-1,3-glucosyltransferase"
MPNKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLDQFLEAGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMESVAEGVPMIFSDFGLDQPLNARYMSDVLHVGVYLEDGLERGEIENAIRRVMVDREGEVMRQNAAKLKDKADRSLAKGGSSYESLESLVSYISSL

SEQ ID NO: 5929 - DNA, 1371 bp, Artificial Sequence
  "Variant of ADP-beta-1,3-glucosyltransferase"
atgcccaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccacagtttttagagcgaggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgcaggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgatcgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggaggacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaacgcctggttagctacattagcagcctg

SEQ ID NO: 5930 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLERGYLDPEDKHRLEEPVVGFPMLKVKDIKRAYSNWQDAKPILDKMIEETRASSGVIWNSFKELEESELETVWREIPAPSFLLPLPKHYRASSSSLQDEDPSVAQWLDQQPPSSVLYVGFGTQSEVDEKDFLEIARGLVDSKQSFLWRVRPGFVKGSEWVEPLPDGFLGDRGRIVKSCPQQEVLAHKAIGAFWTHGGWNGTMEGVAEGVPMIFSDFGLDQPLNARYMSDVLHVGVYLEDGLERGEIENAIRRVMVDREGEVMRQNAAKLKDKADRSLAKGGSSYESLERLVSYISSL

SEQ ID NO: 5931 - DNA, 1371 bp, Artificial Sequence
  "Variant of ADP-beta-1,3-glucosyltransferase"
atgcccaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccgtcagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccacagtttttagagcgaggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaacgcctggttagctacattagcagcctg

SEQ ID NO: 5932 - protein, 457 aa, Artificial Sequence
  "Variant of ADP-beta-1,3-glucosyltransferase"
MPNKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPSDEEVACLITDALWYFAQPVADSLNLPRLVLMTSSLFNFHALVSLPQFLERGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSLAKGGSSYESLERLVSYISSL

SEQ ID NO: 5933 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccacagtttttagaggcgggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagagcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 5934 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLEAGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMESVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 5935 - DNA, 1371 bp, Artificial Sequence
  "Variant of ADP-beta-1,3-glucosyltransferase"
atggaaaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggaccagtttttagaggcgggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagagcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 5936 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLDQFLEAGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMESVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 5937 - DNA, 1371 bp, Artificial Sequence
  "Variant of ADP-beta-1,3-glucosyltransferase"
atgcccaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggaccagtttttagagctaggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgatcgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctacattagcagcctg

SEQ ID NO: 5938 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLDQFLELGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGDRGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 5939 - DNA, 1371 bp, Artificial Sequence
  "Variant of ADP-beta-1,3-glucosyltransferase"
atgcccaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccgtcagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccacagtttttagagctaggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 5940 - protein, 457 aa, Artificial Sequence
  "Variant of ADP-beta-1,3-glucosyltransferase"
MPNKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPSDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 5941 - DNA, 1371 bp, Artificial Sequence
  "Variant of ADP-beta-1,3-glucosyltransferase"
atgcccaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccacagtttttagagcgaggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttagagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcagacaaagctttctgtggcgggttcgtccgggcttcgtgaagggtagcgagtgggttgagccgctgccggatggttttctgggcgatcgtggtcgtatcgtgaagtcttgcccgcaacaagaagtgctggcgcacaaggcgattggtgcgttctggacccacggcggttggaacggcaccatggagagcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaacgcctggttagctacattagcagcctg

SEQ ID NO: 5942 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLERGYLDPEDKHRLEEPVVGFPMLKVKDIKRAYSNWQDAKPILDKMIEETRASSGVIWNSFRELEESELETVWREIPAPSFLLPLPKHYRASSSSLLDEDPSVAQWLDQQPPSSVLYVGFGTQSEVDEKDFLEIARGLVDSRQSFLWRVRPGFVKGSEWVEPLPDGFLGDRGRIVKSCPQQEVLAHKAIGAFWTHGGWNGTMESVAEGVPMIFSDFGLDQPLNARYMSDVLHVGVYLENGLERGEIENAIRRVMVDREGEVMRQNAAKLKDKADRSLAKGGSSYESLERLVSYISSL

SEQ ID NO: 5943 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccgtcagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggaccagtttttagaggcgggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagagcgtggcggaaggcgttccgatgatctttagcgatttcggtctggatcagccgctgaacgcgcgttacatgagcgatgttctgcatgtgggcgtttatctggaggacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 5944 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPSDEEVACLITDALWYFAQPVADSLNLPRLVLMTSSLFNFHALVSLDQFLEAGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMESVAEGVPMIFSDFGLDQPLNARYMSDVLHVGVYLEDGLERGEIENAIRRVMVDREGEVMRQNAAKLKDKADRSLAKGGSSYESLESLVSYISSL

SEQ ID NO: 5945 - DNA, 1371 bp, Artificial Sequence
  "Variant of ADP-beta-1,3-glucosyltransferase"
atggaaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccgtcagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccacagtttttagaggcgggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagagcgtggcggaaggcgttccgatgatctttagcgatttcggtctggatcagccgctgaacgcgcgttacatgagcgatgttctgcatgtgggcgtttatctggaggacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctacattagcagcctg

SEQ ID NO: 5946 - protein, 457 aa, Artificial Sequence
  "Variant of ADP-beta-1,3-glucosyltransferase"
MENTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPSDEEVACLITDALWYFAQPVADSLNLPRLVLMTSSLFNFHALVSLPQFLEAGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMESVAEGVPMIFSDFGLDQPLNARYMSDVLHVGVYLEDGLERGEIENAIRRVMVDREGEVMRQNAAKLKDKADRSLAKGGSSYESLESLVSYISSL

SEQ ID NO: 5947 - DNA, 1371 bp, Artificial Sequence
  "Variant of ADP-beta-1,3-glucosyltransferase"
atgcccaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccgtcagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggaccagtttttagagcgaggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcagacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagagcgtggcggaaggcgttccgatgatctttagcgatttcggtctggatcagccgctgaacgcgcgttacatgagcgatgttctgcatgtgggcgtttatctggaggacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaacgcctggttagctacattagcagcctg

SEQ ID NO: 5948 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPSDEEVACLITDALWYFAQPVADSLNLPRLVLMTSSLFNFHALVSLDQFLERGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSRQSFLWRVRPGFVKGSEWVEPLPDGFLGERGRIVKSCPQQEVLAHKAIGAFWTHGGWNGTMESVAEGVPMIFSDFGLDQPLNARYMSDVLHVGVYLEDGLERGEIENAIRRVMVDREGEVMRQNAAKLKDKADRSLAKGGSSYESLERLVSYISSL

SEQ ID NO: 5949 - DNA, 1371 bp, Artificial Sequence
  "Variant of ADP-beta-1,3-glucosyltransferase"
atgcccaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccacagtttttagaggcgggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagagcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctacattagcagcctg

SEQ ID NO: 5950 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLEAGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMESVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 5951 - DNA, 1371 bp, Artificial Sequence
  "Variant of ADP-beta-1,3-glucosyltransferase"
atggagaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggaccagtttttagaggcgggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagagcgtggcggaaggcgttccgatgatctttagcgatttcggtctggatcagccgctgaacgcgcgttacatgagcgatgttctgcatgtgggcgtttatctggaggacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctacattagcagcctg

SEQ ID NO: 5952 - protein, 457 aa, Artificial Sequence
  "Variant of ADP-beta-1,3-glucosyltransferase"
MENTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLDQFLEAGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMESVAEGVPMIFSDFGLDQPLNARYMSDVLHVGVYLEDGLERGEIENAIRRVMVDREGEVMRQNAAKLKDKADRSLAKGGSSYESLESLVSYISSL

SEQ ID NO: 5953 - DNA, 1371 bp, Artificial Sequence
  "Variant of ADP-beta-1,3-glucosyltransferase"
atgcccaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccgtcagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccacagtttttagaggcgggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 5954 - protein, 457 aa, Artificial Sequence
  "Variant of ADP-beta-1,3-glucosyltransferase"
MPNKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPSDEEVACLITDALWYFAQPVADSLNLPRLVLMTSSLFNFHALVSLPQFLEAGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 5955 - DNA, 1371 bp, Artificial Sequence
  "Variant of ADP-beta-1,3-glucosyltransferase"
atgcccaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggaccagtttttagagctaggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttagagagctggaggaaagcgagctggaaaccgtttggcgtgaaattccggcgccgagcttcctgcttccgctgccgaagcactatagggcgagcagcagcagcctgcaggacgaagatccgagcgtggcccaatggctggaccagcaaccgccgagcagcgtgctgtacgttggctttggcacccagagcgaggtggacgaaaaagatttcctggagattgcgcgtggtctggttgacagcagacaaagctttctgtggcgggttcgtccgggcttcgtgaagggtagcgagtgggttgagccgctgccggatggttttctgggcgatcgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 5956 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLDQFLELGYLDPEDKHRLEEPVVGFPMLKVKDIKRAYSNWQDAKPILDKMIEETRASSGVIWNSFRELEESELETVWREIPAPSFLLPLPKHYRASSSSLQDEDPSVAQWLDQQPPSSVLYVGFGTQSEVDEKDFLEIARGLVDSRQSFLWRVRPGFVKGSEWVEPLPDGFLGDRGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 5957 - DNA, 1371 bp, Artificial Sequence
  "Variant of ADP-beta-1,3-glucosyltransferase"
atggaaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccgtcagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggaccagtttttagaggcgggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgatcgtggtcgtatcgtgaagtcttgcccgcaacaagaagtgctggcgcacaaggcgattggtgcgttctggacccacggcggttggaacggcaccatggagagcgtggcggaaggcgttccgatgatctttagcgatttcggtctggatcagccgctgaacgcgcgttacatgagcgatgttctgcatgtgggcgtttatctggaggacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctacattagcagcctg

SEQ ID NO: 5958 - protein, 457 aa, Artificial Sequence
  "Variant of ADP-beta-1,3-glucosyltransferase"
MENTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPSDEEVACLITDALWYFAQPVADSLNLPRLVLMTSSLFNFHALVSLDQFLEAGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGDRGRIVKSCPQQEVLAHKAIGAFWTHGGWNGTMESVAEGVPMIFSDFGLDQPLNARYMSDVLHVGVYLEDGLERGEIENAIRRVMVDREGEVMRQNAAKLKDKADRSLAKGGSSYESLESLVSYISSL

SEQ ID NO: 5959 - DNA, 1371 bp, Artificial Sequence
  "Variant of ADP-beta-1,3-glucosyltransferase"
atgcccaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccgtcagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccacagtttttagagcgaggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaacgcctggttagctacattagcagcctg

SEQ ID NO: 5960 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPSDEEVACLITDALWYFAQPVADSLNLPRLVLMTSSLFNFHALVSLPQFLERGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSLAKGGSSYESLERLVSYISSL

SEQ ID NO: 5961 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccgtcagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggaccagtttttagagcgaggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagagcgtggcggaaggcgttccgatgatctttagcgatttcggtctggatcagccgctgaacgcgcgttacatgagcgatgttctgcatgtgggcgtttatctggaggacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctacattagcagcctg

SEQ ID NO: 5962 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPSDEEVACLITDALWYFAQPVADSLNLPRLVLMTSSLFNFHALVSLDQFLERGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMESVAEGVPMIFSDFGLDQPLNARYMSDVLHVGVYLEDGLERGEIENAIRRVMVDREGEVMRQNAAKLKDKADRSLAKGGSSYESLESLVSYISSL

SEQ ID NO: 5963 - DNA, 1371 bp, Artificial Sequence
  "Variant of ADP-beta-1,3-glucosyltransferase"
atggaaaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggaccagtttttagagcgaggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcagacaaagctttctgtggcgggttcgtccgggcttcgtgaagggtagcgagtgggttgagccgctgccggatggttttctgggcgatcgtggtcgtatcgtgaagtcttgcccgcaacaagaagtgctggcgcacaaggcgattggtgcgttctggacccacggcggttggaacggcaccatggagagcgtggcggaaggcgttccgatgatctttagcgatttcggtctggatcagccgctgaacgcgcgttacatgagcgatgttctgcatgtgggcgtttatctggaggacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctacattagcagcctg

SEQ ID NO: 5964 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLDQFLERGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSRQSFLWRVRPGFVKGSEWVEPLPDGFLGDRGRIVKSCPQQEVLAHKAIGAFWTHGGWNGTMESVAEGVPMIFSDFGLDQPLNARYMSDVLHVGVYLEDGLERGEIENAIRRVMVDREGEVMRQNAAKLKDKADRSLAKGGSSYESLESLVSYISSL

SEQ ID NO: 5965 - DNA, 1371 bp, Artificial Sequence
  "Variant of ADP-beta-1,3-glucosyltransferase"
atggaaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagagcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaacgcctggttagctacattagcagcctg

SEQ ID NO: 5966 - protein, 457 aa, Artificial Sequence
  "Variant of ADP-beta-1,3-glucosyltransferase"
MENTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMESVAEGVPMIFSDFGLDQPLNARYMSDVLHVGVYLENGLERGEIENAIRRVMVDREGEVMRQNAAKLKDKADRSLAKGGSSYESLERLVSYISSL

SEQ ID NO: 5967 - DNA, 1371 bp, Artificial Sequence
  "Variant of ADP-beta-1,3-glucosyltransferase"
atgcccaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccacagtttttagagctaggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagagcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaacgcctggttagctacattagcagcctg

SEQ ID NO: 5968 - protein, 457 aa, Artificial Sequence
  "Variant of ADP-beta-1,3-glucosyltransferase"
MPNKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMESVAEGVPMIFSDFGLDQPLNARYMSDVLHVGVYLENGLERGEIENAIRRVMVDREGEVMRQNAAKLKDKADRSLAKGGSSYESLERLVSYISSL

SEQ ID NO: 5969 - DNA, 1371 bp, Artificial Sequence
  "Variant of ADP-beta-1,3-glucosyltransferase"
atgcccaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccgtcagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgatcgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggaggacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 5970 - protein, 457 aa, Artificial Sequence
  "Variant of ADP-beta-1,3-glucosyltransferase"
MPNKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPSDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGDRGRIVKSCPQQEVLAHKAIGAFWTHGGWNGTMEGVAEGVPMIFSDFGLDQPLNARYMSDVLHVGVYLEDGLERGEIENAIRRVMVDREGEVMRQNAAKLKDKADRSLAKGGSSYESLESLVSYISSL

SEQ ID NO: 5971 - DNA, 1371 bp, Artificial Sequence
  "Variant of ADP-beta-1,3-glucosyltransferase"
atggaaaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggaccagtttttagaggcgggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgcaggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgatcgtggtcgtatcgtgaagtcttgcccgcaacaagaagtgctggcgcacaaggcgattggtgcgttctggacccacggcggttggaacggcaccatggagagcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaacgcctggttagctacattagcagcctg

SEQ ID NO: 5972 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLDQFLEAGYLDPEDKHRLEEPVVGFPMLKVKDIKRAYSNWQDAKPILDKMIEETRASSGVIWNSFKELEESELETVWREIPAPSFLLPLPKHYRASSSSLQDEDPSVAQWLDQQPPSSVLYVGFGTQSEVDEKDFLEIARGLVDSKQSFLWRVRPGFVKGSEWVEPLPDGFLGDRGRIVKSCPQQEVLAHKAIGAFWTHGGWNGTMESVAEGVPMIFSDFGLDQPLNARYMSDVLHVGVYLENGLERGEIENAIRRVMVDREGEVMRQNAAKLKDKADRSLAKGGSSYESLERLVSYISSL

SEQ ID NO: 5973 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcgtcctcgctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggatcagcaaccgcccagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgggaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 5974 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVASSLNLPRLVLMTSSLFNFHALVSLPQFLELGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 5975 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 5976 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 5977 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggatcagcaaccgaagagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggcgaacgtggtcgtatcgtgaagtcttgcccgcaacaagaagtgctggcgcacaaggcaattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 5978 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPKSSVLYVGFGTQSEVDEKDFLEIARGLVDSKQSFLWRVRPGFVKGSEWIEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSLAPGGSSYESLESLVSYISSL

SEQ ID NO: 5979 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcgtccgcgctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggctcagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtcgcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 5980 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVASALNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLAQQPPSSVLYVGFGTQSEVDEKDFLEIARGLVDSKQSFLWRVRPGFVKGREWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 5981 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtcgcgagtggattgagccgctgccggatggttttctgggcgaacgtggtcgtatcgtgaagtcttgcccgcaacaagaagtgctggcgcacaaggcaattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 5982 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGREWIEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 5983 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggatcagcaaccgaagagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 5984 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPKSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 5985 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggatcagcaaccgcccagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttaccgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 5986 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFTDFGLDQPLNARYMSDVLHVGVYLENGLERGEIENAIRRVMVDPEGEVMRQNAAKLKDKADRSLAPGGSSYESLESLVSYISSL

SEQ ID NO: 5987 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcgtccgcgctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggatcagcaaccgcccagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcatgtgatggttgacccggaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 5988 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVASALNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRHVMVDPEGEVMRQNAAKLKDKADRSLAKGGSSYESLESLVSYISSL

SEQ ID NO: 5989 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggctcagcaaccgcccagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagctgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 5990 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLAQQPPSSVLYVGFGTQSEVDEKDFLEIARGLVDSKQSFLWRVRPGFVKGSEWVELLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSLAPGGSSYESLESLVSYISSL

SEQ ID NO: 5991 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggatcagcaaccgcccagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaagacgcgattaggcgtgtgatggttgacccggaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 5992 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIEDAIRRVMVDPEGEVMRQNAAKLKDKADRSLAKGGSSYESLESLVSYISSL

SEQ ID NO: 5993 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggctcagcaaccgcccagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcaattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 5994 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLAQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAKGGSSYESLESLVSYISSL

SEQ ID NO: 5995 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaattgctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 5996 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQLLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 5997 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagcaattggcaggaggctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 5998 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQEAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 5999 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagcaattggcaggaggctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcccggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 6000 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQEAKPILDKMIEETRASSGVIWNSFKELEESELETVWREIPAPSFLLPLPKHYRASSSSLLDEDPSVAQWLDQQPPSSVLYVGFGTQSEVDEKDFPEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 6001 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggagaatcccgatcattaacaagctcggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagcaattggcaggaggctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 6002 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWRIPIINKLGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQEAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 6003 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagcaattggcagattgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 6004 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQIAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 6005 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagtcgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 6006 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVESLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 6007 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagcaattggcagattgctaaaccaattctggataagatgattgaagaaacccgtgcgagcagcggtgtgatttggaacagctttaaagagctggaggaaagcgagctggaaaccgtttggcgtgaaattccggcgccgagcttcctgcttctgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 6008 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQIAKPILDKMIEETRASSGVIWNSFKELEESELETVWREIPAPSFLLLLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 6009 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagcaattggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 6010 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 6011 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagcaattggcaggaggctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 6012 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQEAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 6013 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggttggagaatcccgatcattaacaagcacggcgcggatgaattccgtaaagagctggaaagccttatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagcaattggcagattgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgaccgtgaaggtgaggtgatgcgtcaaaacgcggcgaaactgaaggataaagcggatcgaagcctggctaagggtggcagcagctacgagagcctggaaagcctggttagctatattagcagcctg

SEQ ID NO: 6014 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGWRIPIINKHGADEFRKELESLMRDSPEDEEVACLITDALWYFAQPVADSLNLPRLVLMTSSLFNFHALVSLPQFLELGYLDPEDKHRLEEPVVGFPMLKVKDIKRAYSNWQIAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDREGEVMRQNAAKLKDKADRSLAKGGSSYESLESLVSYISSL

SEQ ID NO: 6015 - DNA, 1371 bp, Artificial Sequence
  "Variant of ADP-beta-1,3-glucosyltransferase"
atggaaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggaggacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6016 - protein, 457 aa, Artificial Sequence
  "Variant of ADP-beta-1,3-glucosyltransferase"
MENTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLEDGLERGEIVNAIRRVMVDPEGEVMRQNAAKLKDKADRSLAPGGSSYESLESLVSYISSL

SEQ ID NO: 6017 - DNA, 1371 bp, Artificial Sequence
  "Variant of ADP-beta-1,3-glucosyltransferase"
atgccaaacaaaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6018 - protein, 457 aa, Artificial Sequence
  "Variant of ADP-beta-1,3-glucosyltransferase"
MPNKTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWLVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6019 - DNA, 1371 bp, Artificial Sequence
  "Variant of ADP-beta-1,3-glucosyltransferase"
atggaaaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtcttgcccgcaacaatgggtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaacgcctggttagctatattagcagcctg

SEQ ID NO: 6020 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWLVRPGFVKGSEWVEPLPDGFLGERGRIVKSCPQQWVLAHKAIGAFWTHGGWNGTMEAVAEGVPMIFSDFGLDQPLNARYMSDVLHVGVYLENGLERGEIENAIRRVMVDPEGEVMRQNAAKLKDKADRSLAPGGSSYESLERLVSYISSL

SEQ ID NO: 6021 - DNA, 1371 bp, Artificial Sequence
  "Variant of ADP-beta-1,3-glucosyltransferase"
atgccaaacaaaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6022 - protein, 457 aa, Artificial Sequence
  "Variant of ADP-beta-1,3-glucosyltransferase"
MPNKTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWLVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6023 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaatgggtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6024 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQWVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6025 - DNA, 1371 bp, Artificial Sequence
  "Variant of ADP-beta-1,3-glucosyltransferase"
atggagaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagaggctggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6026 - protein, 457 aa, Artificial Sequence
  "Variant of ADP-beta-1,3-glucosyltransferase"
MENTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLEAGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWLVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6027 - DNA, 1371 bp, Artificial Sequence
  "Variant of ADP-beta-1,3-glucosyltransferase"
atgccaaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggaggacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6028 - protein, 457 aa, Artificial Sequence
  "Variant of ADP-beta-1,3-glucosyltransferase"
MPNKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLEDGLERGEIENAIRRVMVDPEGEVMRQNAAKLKDKADRSLAPGGSSYESLESLVSYISSL

SEQ ID NO: 6029 - DNA, 1371 bp, Artificial Sequence
  "Variant of ADP-beta-1,3-glucosyltransferase"
atggaaaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6030 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6031 - DNA, 1371 bp, Artificial Sequence
  "Variant of ADP-beta-1,3-glucosyltransferase"
atgccaaacaaaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaacgcctggttagctatattagcagcctg

SEQ ID NO: 6032 - protein, 457 aa, Artificial Sequence
  "Variant of ADP-beta-1,3-glucosyltransferase"
MPNKTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIVNAIRRVMVDPEGEVMRQNAAKLKDKADRSLAPGGSSYESLERLVSYISSL

SEQ ID NO: 6033 - DNA, 1371 bp, Artificial Sequence
  "Variant of ADP-beta-1,3-glucosyltransferase"
atgccaaacaaaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaactgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6034 - protein, 457 aa, Artificial Sequence
  "Variant of ADP-beta-1,3-glucosyltransferase"
MPNKTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWLVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6035 - DNA, 1371 bp, Artificial Sequence
  "Variant of ADP-beta-1,3-glucosyltransferase"
atggaaaacaaaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagaggctggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6036 - protein, 457 aa, Artificial Sequence
  "Variant of ADP-beta-1,3-glucosyltransferase"
MENKTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLEAGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6037 - DNA, 1371 bp, Artificial Sequence
  "Variant of ADP-beta-1,3-glucosyltransferase"
atgccaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6038 - protein, 457 aa, Artificial Sequence
  "Variant of ADP-beta-1,3-glucosyltransferase"
MPNTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWLVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6039 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6040 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6041 - DNA, 1371 bp, Artificial Sequence
  "Variant of ADP-beta-1,3-glucosyltransferase"
atgccaaacaaaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagaggctggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6042 - protein, 457 aa, Artificial Sequence
  "Variant of ADP-beta-1,3-glucosyltransferase"
MPNKTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLEAGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWLVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIENAIRRVMVDPEGEVMRQNAAKLKDKADRSLAPGGSSYESLESLVSYISSL
